United States Patent 8,110,361 (DNA METHYLATION MARKERS ASSOCIATED WITH THE CPG ISLAND METHYLATOR PHENOTYPE (CIMP) IN HUMAN COLORECTAL CANCER) - sequence listing, part 2

SEQ ID NO: 228 - DNA, 68851 bp, Artificial Sequence
  Chemically-Treated DNA
gtattttgaaaatatatttaaaaatattaaaaattttatatttaaaatatatattatatgttaattagtatatttaaatagaatttgtatttataataggtttttgatgtggttaagttttaatgttaattttttttaataatataattatataaatatattaaaatataataaatattgttttttgttttatatggtgaataatatttttattatagagagaataaggttatagatatttatttatatttttaatgggaattgttataaaaaagtaataggtttgttgttatgtatgaaatatttttgttataaagagattatagtaagattttaaaaaataaaataaaatagaataagaatgaatataatagagagagattttaataaaataaattttaggttaatataaattattaagtatgtgattgtgatgtattttattgggtaaaagagttattgattatataattgttggatgtgttttttatgaaattatttaatagatttggtttttgtaattttttaagtttgtgatggggggttgtttgttttaaatttgttttttaaaaggaagttgtataaagttgatatatagtagatattttaagtattttttatatattaaaaataattataaagataatatttttaaataatataaaataaatttatattatgtaaagtttttttttttttaaagaggtatttagatggtattgtgaaagattagttttaaatgaaagattgaataaattgaaattttttgttgatggtatttttatttttgggttatggtgaatatttttttttgtttattttttattttattaagatgtagtaattgtttggggttttttgatatttaaggatgttggtttaagtggtgattattaatatttttaggtgtgaaatgggttgaatgggtttagagttttagtttttattggggatttatttttttaagaattattattttaggtttttaatttgattttttttaatttaaaatggtagaggtgaggtagggattttttttatgaatagataggatgggtagaaggttgttgtggtttttattggggagtaaaattttgttagttttgttttggttttttttattgagtaaggtatttttaagttttggtgttttgaatgtttagatatttttttgaagttttgtttttggataagattttttatgggtttttttgattatttggtttgagtttggggtttttttttttgttttttttttttttattaaaagtttttaaaagataaattttggtttttttaagtttagttttaaagtaataagtgtttaggtagtaaatattttttattttattgtattaattttatgattataaatgttatatttggtttttaatttgttttaggttaatttaattttatgtaaaattatttagaggtgggatggtgggtataagttggtttgagtgtggttttttagttgagaattttttgagtatagttagataatgtaggtatttaaagtatgaggtttaagtagtttgatatatgttattttagagttatttttgaagggttttttagaggtttttgttttggaatgttttaaatattatgttttatttttatttagattttgggatggttatttagaaattttttttgtattgttggtaaatgtaatgttaattttatatagtttttatttggttgtttagttttatgttattggtaatgtggatttttgttttgatttaggtgtttttgggttgatatagggttttattttttgtttataagatattgttaagttttattatgagttttttttaagtttagttatgatttatttaaatgtttattttttataaaaaataatttttattttggggttattttttgttgttttttgttttaaaaaaaaattattgttttttatgtttatatgagtgttatgatgtgatataatgtgtttatttgtttatagtagtggtaaaatattttagaatgtgtaattgattttttttttttaaaataaaataaagaggagattagagggggagggggggaaagaatgtgttttgagtaaatataggtttttttgttaaaagtagtttattttgattaatgtttaaagaatgagtggggtttgggaggtgtattatgggatgtggagtgtgagtatttttttgtttagttgttttaatttttatttattttttagttatttgattgatattgtaaatatttttataatatataaatgtattttttattagttagaatatatattgtaggaattttttttttatttttattttttgtgggaattaaaaaataaaataaataaatgaaaaaaaaatataaaataaataaaaatatattttttattttttattttttaagttagtaaagtaatgataatagtattttgatattgttttaattttaatgttattagaagttaaaagtagtaaaatagatatagtattaataagaatgaagatatttattgtttaaaatgtaaatggaatgttttggtttaaatttttgttgtgtgtgtgtgtgttttttttttgttttttgaaagaggatagtttattattaatttataattaaagtagtatgtaatttattattttttttaattttttatgtttttagtttttggtaatggtaataaattataatattattaaggaatgtaatgtagattttttaagttgtgtgtaaatgattgttttttttttggttatggatatgtttaataaatagattgtagaattattgtattgtataaattttatttatatatgtagtttataaaattattttttttttaattgaataatttattttgttatgtatatatataaatagataatttttgttttaatataatttaatttatataatataaatttattattttttttttttaatggttaatgtatatatataagaagtgtttatttttatgaattgttagttaattttttttttgttatttatggtaagggtttgtatgtatgattgggtagtttggtattgggagttttaatgttttttgtttatgtttttgtagtttttttttgtgtaatttatgggattgtatttggttttgtagaagtattgttttagttggttttttgatatagggatttttttaaggattgtgattgttttgtttgatatgtttattgtagtttttttgtttgttgttgttatttatttattaatattgttatatatgtttagttttttttggtgggtagggttagagtggtgttggatttttatggatatgtttgtagtatttaggtaatttttgtatttttttagtagaaagagaagaggaggttttaaaggtatttgattattgagtattattttggatgtgtataagtttgtgtttttattgttttttttattgggttgaattttttggtttttatttaatagtttttttattatgtgtttgaaagtgttagttaatgatgttaagttttttgaatttgttttgggtttatttatgttttttagagttttatgggtttgtatatttgggtaggttaagttattttgtttttggatgtttgttttttttatgggggtagtttttatgtaattaaagtatgaaataattatagtaaggaaaaggatggttattattttttttatttggtggaattgtagggagaaagtagaaataagatagaaaattggttagggtttttttttattgggatgttatgtggtttatttgattgtaattttaggttattttgtagggttaaggtttttttatgttttggtgataaattttagttgtattagatataaattagtgttagtagtgtgttgtatgtggtttaatataaattagagatatgtagtgttttttttaagatttagtatataaatttgagattagatggtttttaagtaagtgtaaaaattgtggttttaagttttttttttttttattttagtagttttgtaagtttaatttttaatgatttttgtttatgttgttatgagaaatataaaattataaatgttattaagtaataattgtaagtgtaattaatagtaattttttttaagttagtaatatggttttttgtaggaatgtgtgataggaatagtagtggtttgaggggtttgatgggtttttttagttatgtgatgtttaggtatgaatagtataataaaatagtagttggggaattataaggagtttttaaattgatttttttttttttttttttatagagatattttattatagtaaagaagaaagataattttattgagttattttgttttataggtaaggaaattaaaggttatagaagatttgttttatgttatgaagaaagtttatgttagaatttagggtttttaattttattgttttttattttatatttgggtggttataattgaaaatgttttgtttatttttaaatagaaattattttttgatatgtttattttaatgatgtgtttatgtttggggttaatgttatgaaaataatgtgtttggtaaggagaaaattgaaaaagttagtattaaaaagatatttaagtttattttaaatgttttttatatgtagattttattttattttttttagttttttaaaattttttattttttggttttttttggttaatatatatatttagttaagaaagtttaatttttttttttattagagatgttttttttgtgtgtgtgtgtgtgtgtgtgtgtgtgtgtgtgtgtgtgttttgagtttattttatttttaaaaagttgagtggtgttttatatattttggaataggtagttagtgtttttttttttgtttttgaagttttttgggaagttttttaaaagtatattataaaattaatttttttttgtttgttagagggttgttttattttaaatttggttttatatttataagtatgttttaggaagttaattaaaatggatgaataagtaaaatgaaaatatatttatggattaatttaaggttattgttaggtggtgaaggattttagaattatttatttgaagtattgtgttttttagtagtaaagagtagtatttttagttttgattttaattttatttttattttttagttttgaggtatggatttataaaaagatatatatatgtaatggttattatgatatttaaataagtaggaaaaggaattgtgtttttgtttatgaagttttattgaatttaaaggtaatttatttttagttaataggttagaatgtagaaatggttgaaaattttggtattgaaaagtaaatgttttttatttttgtaagaaataatatttttaattattaagagattttattattatttttaaatatataaaaaaattttttttagatttatttttattttgtatgaatagtaaatatgtttagaattgtttagattgtataatgtttttagattaggaagggaaaattggtttgaataaaatatagatgtttattttgttaataattaaatttttgtgaatgttttgagttttgtattattaaagaaatagattgtttatgggggtttttatttttggtagattgtatttatatattgaatgaaaaagtttttttttaatatttttagtttaaataaaaataatttaaggggtattttttatttaggttaataaaagtttgtaaatgtggaatattttagttatttatattatattggtagagattttttgtgattagttattttttaatattatatttaattaaatttaagatattattattgtgaaatttgatattttatatattattaagaaagtaaaaatgtagtttgggtgattagagtgaaattttattttaaaaaaaaaaaaaaaagaattaatgaattatagtttaatatatatttattaagtgtttatattaattatttaaaaatggtttaaaatattgaggtattttaagttgttggaaaattgttttgtttttattattatagtaatgagtttttgaatgatattattttttatatttggtttttagtttattttgttttttattgattttatttttttattaataattttatgagaaaaataattaatgttttatatattgtttttttagttttatgagtaaatattttagagggaaaattggtatttgagtaaatattatttggtttttattttgaagtttaaatatgggtattttttaagttgagtatttgtatagaattaggaattaatataatggtgataaagtttaattttatattgtaagttttgttttttgagtggtatttttgtaattttaattaattgtttatttatttgtaaggttttgaagttaagtgggtgtaatattaaatttaatattttttgttggaatagtggtattttttattttttttaataatggttttttgatattttgggtaatttaggtataggatagaaattttggaattaagtttgataatatattttttgtatagttttttaatttagttagtaaagatgttttgttaattttttttttaaaatatttgttttggttatttttttttatttattttattgttattattttggtttagtttttattattttattttgtgattataatgttttgatgttgtattagatattttttttgttttatttaattttgatgattattttttgggtaattattttaatattatttttttatataaaaattggtaatggtatttttgttttatttgtttaaatttaatgttttttttttgatatttaattttttttaatatttgtttttattttttttagttaatttttttaaattatttaatgttttattatttttgttttgattaggatagagtttttggagtgttgtatatattattgttttttgatttgttttatttttttgataaattttttttttttttttatttgttgttaaaattttgtttattttttatgatttagtttaagtattaaattatgtatgtttttttttttaattattttagtatatattgttttttttttttaaaattttatattatattttatgtagtatttgattttttttttatttgttttgttttgttttttttttaagatagagttttgttttgttgtttaggttggagtgtaatggtgtaattttggtttattgtaatttttattttttgggtttaagtaatttttttgttttagtaggaggtagttgggattataggtgtttattattatgtttggttaatttttgtatttttagtagagatagggttttattatgttggttgagttggtttatttatttgttaattgttaattgtatttgtttattttagttagtttttagttgaaaggtaagttttttgagggaatggattatgtttgagtttttataatgtttaatagagaaaaatgtaatagtagtatttagtaaaaatttattgataggtttattaaattaagagaaaagatagtttggatataatttttgtaagaagtttttttatttggaaagattagtgaatttattgaaatttttaggtaaatataggttgtgttaattttaaattataaattttaaggtagtggttttaatttttttggtagtaggaattagttttgtggaagataatttttttatggtttgggagtagtagggtggatggttttgggatgaaatggttttattttagattattagttaaattattataaggaattggatttttataaggagtatataatttagattttttgtatgtgtagtttataatagggtttatgtttttatgagaatttaatgttgttgttgatttgaaaggagatagagtttagatggtaatgtttgtttatttgttgtttattttttattgtgtagtttggtttttaataggttagggattggtaataatttatggtttgggtgttgtggatttttgttttaaggaatttgatagatagtaattattagttatgattaattttttgagtttttttaatggaataaaattttatttgaataattaaaaagtagataatattattatatattaattgttttataattttttgtgtagttttatttttaatagattaataagagatttgggaagtaataataataataatagtaaaatttgtagtttttagttttttaattttttgttttttattttgttaagtttttaatgagtaattttatatattgtattaggaaataataaaagattaagtaagagtttttaggataattttttatttttaatttttggatgattttttattatatataagataaagaggttgtgtaatattgttaagtagattatatatttatttatatttaataaatttattgatgttgtttaattttgttttaaggtttatagttattaatttaattatatttataaaatgttaggaaggtttttatagttttattgttaggaaatttaatatagtatatagaattaaaaagaaaattaatgaagtagatattaagtttagttttaagtgtgatttataagttttagatattttattgaaagaatgtttataataatatgtttttttatttttgttgtagttataatttatatttgtttaagagattatagaatatttataggtgttatttaatttgatttttataaggagataggatgggtattattatttttattatatagatgaggtaattatgtgttagagaggttaggtaatttgttaaatgttataaagttagtaggttatttgttttttgaattaagtttttattattaggatgtgttgttagttttagaatattagttatagagaagagagtggttgtgataatgaaggagtttataaaatgtggatattgtagttatgtgtgttttggaatttaattttttaaaaggagtgttattaagatattattttgtaggtttagattaattatgattaagattttttaattttaaggtttgattatttaaatggatgaaattttagataatgtggtttttttttaagagaaagaattgtaaaaattgtagtatgttagaattaagtttttatggttaaaggtgggaaaataagtaatagtatagataatttaggtatatagaaaaaaaaaaaagttttgtttgtttttagtttttttgggttttatttgtgagtgtgtaattagagaaaatatagtttaaagatatggttgtttattttagatagttttataaagataatggtaatgttgaagaagttattaatatttggtttttaatatatatgatataaattattaagagttgattttaatgaaattttgtaaattaatatttaaaaatttttaatttgtatttagttgattatatttatatgttagatttttttttgtttatttatttattatatatgaagtttattttttagttttatttatttttttttttaggagggaggtaggatatatgtaattagaatataaaggtagaaatgatttagaaaaggtatagatataattttataaagagaaagaagttatttttagttagggaataaaggaatgtattgttaagaaggttgtaaagggttaggtgtagtggtttatatttgtaattttaatattttgggaggttgaggtgggaggattattagagtttaggaatttgagattaatttgggtaatatagtgagattatgtttttataaaaatttaaaaattaaaaaaattaggtgtggtggtgtatatttgtagttttagttatttgggaggttgaggtgggaggattatttgagtttaagaagttgaggttatagtgagtgattgattatgttattgaattttagtttgggtgatagagatattattgttttaggaaagtaattgttttgttgtaattaatgaaggtttttgatagttagagttatttagaatttatagttatattgaattttgtttttattttttgtttttttgttatagagtaatattgttttagtagtatatatttttagtttgtaataaagaagttttagtattaagtatatttaagttatttggatagtaaatgaggttatttgaaaatatttttaaagtttatttttttaaaaaatagttttttgtttataggatttaaatggtagttgatattttttgtaaaagtttaatttttttaattagaattttgttttttttagaattttaggtgggatttgttataatttattgaagtttagatttgataatgttttatttattatgttattgaaattatataatatttattaaatttttatatatggtagatagtgatattaattaagaagataatttttaatttgttttatgaagttttagtgatttattttgtaataaagaatttggaaagggaggttttaagatggttaaatatgaatagttttagtttatagtttttagtgtgagtgatgtagaagatgggtgatttttgtatttttaattgaggtattgggtttattttattggggtttgttagatagtgggtataatttatggagtatgagttaaagtagggtggggtattattttatttaggaagtataaggggttggggaatttttttttttagttaagggaagttatgattgatggtatttggaaaattaggatattttttattttaatattgtgtttttttaatggttttagtaaatggtatattaggagattatgttttaggtttggtttggagggttttatgtttatggagtttggtttattgttagtatagtagtttgagattgaattgtaaagtagtagtgaggttgggggaggggtgtttattattgttgagatttgagtaggtaaataaagtagttaggaagtttgaaatgggtggagtttattgtagtttaaggaggtttgtttgtttttgtagattttatttttaggggtagggtatagttgaataaaagatagtagaaatttttgtagatttaaatgtttttgtttgatagttttgaaaagagtaggggtttttttagtatggaatatgatatttgagaatggatagtttgtttttttaagtgggtttttgatttttgagtagtttaattgggaggtattttttagtaggggttgattgatattttatatggttaggtgtttttttgagatgaagtttttagaggaataattagggagtaatatttgttgttttgtaatatttgttgttttgtagtttttgttggtgatatttaagtaaatagggtttggagtggatttttagtaaattttaatagatttgtagttgagggttttgattgttagaaggaaaattaataaagagaaagaatatttatattaaaattttatttgtatgttattattattaaagattaaaggtagataaaattaataagatggggagaaattagagtagagaagttgaaaattttaaaaattagagtatgtttttttttttaaaggaatgtagttttttgttagtaatggaataaagttggatagagaatgatttttataagttgagagaagaaggttttagatgattagtaataataaatttttttgagttaaaggaggatgtttgaattttttagtaaagaagttaaaaattttgaaaaaatattagatgaatggttaattagaaaaaatagtatagagaagattttaaatgatttgatggagttgaaaattatggtatgagaattatgtgatatatgtataagttttagtagttgatttaattaagtggaagaaagggattgaagattaaatgaatgaaatgaagtaagaagagaagtttagagaaaaaagagtaaaaagaaatgaataaagtttttaagaaatatgggattatgtgaaaagattaaatttatatttgattggtgtatttgaaagtgatggggagaatggaattaagttggaaaatgttttgtaggatattatttaggagaatttttttaatttagtgaggtaggttagtatttaaatttaggaaatatagagaatgttgtaaagatattttttaagaagagtaatttaaagatatataattgttagatttattaaagttgaaatgaaggaaaaaatattaagtgtagtgagagagaaagggtaggttatttataaagggaagtttattagattaatagtattttttggtagaaattttataagttagaagagagtgggggttaatatttaatatttttaaagaaaagaatttttaatttagaattttatatttagttaaattaagttttataagtgaaggagaaataaaattttttatagataagtaaatgttgagagattttgttattattaggtttgttttataagagtttttgaaggaagtattaaatatggaaaggaataattagtattagttattgtaaaaatatgttaaattgtaaagattattgaggttaggaagaaattgtattaattaatgagtaaaataattagttaatattataatgataggattaaatttatatataataatattaattttaaatgtaaatgggttaaatgttttagttaaaagatatggattggtaaattggataaagagttaagatttattagtgtgttgtatttagtagatttattttatgtgtagagatgtatataggtttaaaataaagggatggaggaagatttattaaggaaatggaaagtaaaaaaaagtaggagttgtaattttagtttttgataaaatagattttaaattaataaagattaaaagagataaagaaggttattatataatgataaagggattaatttaataagaagagttaattattttaaaaatatatgtatttaatataggagtattagatttataaagtaagtttttagagatttataaagagatttagatttttatataataataatgggagattttattattttatggttaatattagatagattaataagatagaaaattaataaagatatttagaaattgaatttagttttgtattaagtggatttaatagatatttatagaattttttattttaaattaatagaatatatattttttttggtattatattatatttattttaaaaattgattatatagttggaagtaaagtattttttagtaaatgtaaaagaatagaaattataataaattgttttttagattatagtgtttttaaattagaatttaggattaagaaatttatttagaattatttaattatatggaaattgagtaatttgtttttgagtgattattgggtatttaatgaagtgaaggtagaaataaagatgttttttgaaattaatgagaataaagatataatatattagaatttttgggatatatttaaagtagtgtgtagagggaaatttatagtattaaatgtttataagagaaagtaggaaagatttaaaattgatattttaatattataatttagagaagtaagagtaaatatatttaaaagttagtagaagataagaaataattaagattagagtagaattgaaggagatagagatagaaaaatttttttaaaaaattaatgaatttaggagttggttttttaaaaagattaataaaattgatagattattagtaagattaataaagaagaaaagagaaaagaattaaatagatgtaataaaaggtgataaaggggatattattattaattttatagaaatataaattattattagagaatattataaatatttttatgtaaataaattagaaaatttaaaagaaatttataaatttttggatatatatatttttttaggattaaattaggaagaagttgaattttttaatagattaataataggttttgaaattgaggtaataattaatagtttattaattaaaaaaatttattaggattagatggatttatagttgaattttattagaggtataaggaggagttggtattattttgaaattattttaattaatagaaaaagagggaattttttttaatttattttatgaggttagtattattttgatattatagtttgatagagatataataaaaaaagagaattttaggttaatatttttgatgaagattgatggaaaaatttttagtaaaatattggtaaattgaatttagtagaatattaaaaagtttatttattatgattaagttggttttatttttgggatgtaaggttggtttaatatatgtaaattaataaatataatttattatataaatagaattaaagataaaaattatgattattttaatagatgtagaaaaggtttttgataaaatttaatagtttttgtgttaaaaattttaaataaattaggtattgatgggatatattttaaaataataagagttatttatgataaatttatagttaatgttatattgaatgggtaaaagttggaagtattttttttgaaaattggtataaaataaggatgttttttgttattatttttatttaatatagtattggatgttttagttagggtaattaggtaatagaaagaaataaaggatatttaaataggaagagaggaagttaaattgtttttgtttgtagatgatatgattgtatatttagaaaattttattattttagtttaaaatttttttaagttgataagtaattttagtaaagttttaggatataaaattaatgtgtaaaaattataagtatttttatatattaataatagataaatagagagttaaattatgagtgaatttttatttataattgttttaaagagaataaaatatttaggaatttaatttataagggatgtggaagatttttttaaggagaattataaattattgtttaaggaaataaaagaggatgtaaataaatggaagaatattttatttttatgggtaggaagaattaatattatgaaaatggttatattatttaaggtaatttatagatttaatgttatttttattaagttattaatgattttttttatagaattggaaaaaaattattttaaagtttatatggaattaaaaaagagtttgtattgttaagataattttaaattaaaagaataaagttggaggtattatgttatttgattttaaattatattataaggttatagtaattaaaatagtatggtattggtattaaaatagagatatagattaatggaatagaatagagtttttagaaataatattatatatttataattatttgatttttgataaatttgataaaaataagaaatggggaaaggattttttatttaataaatggtgttgggaaaattggttagttatatgtagaaagttgaaattggattttttttttatattttatataaaaattaatttaagatgaattaaagatttatatgttagatttaaaattataaaaattttagaagaaaatttaggtaatattatttaggatataggtatggataaggattttatgattaaaatattaaaagtaatggtaataaaagttaaaattgataaatgggatttaattaaattaaagagtttttgtatagtaaaagaaattattattagagtgaataggaaatttatggaatgggagaaaatttttataatttatttatttgataaagggttaatatttagaatttaaaagaatttaaataaatttataagaaaaaattaaatgattttattaaaaagtgggtgaaggatatgaatagatattttttaaaagaagatatttatgtagttaaaagatatatgaaaaaatgtttattattattggttattagagaaatgtaaattaaaattataatgagatattattttatattagttagaatggtgattattaaagtttggaaataataggtgttggaaaggatgtagagaaataggaatatttttatattgttgatgggattgtaaattagtttaaatattgtggaagatagtgtggtgatttttttaggatttagaattagaaatattatttgagttagttattttattattgggtatatatttagaggattataaattatgttattataaagatatatgtatatgtatgtttattgtggtattatttataatagtaaatatttggagttaattaaatgtttattagtgagtaaggatattattttgagtaaattattgtaaggatagaaaattaaatattgtatgtttttatttataggtgggaattgaataatgagaatatttggatatagggtggggaatattatatattgggatttgttatggagtaggggtaggggggagggatagtattaggagatatatttaatgtaaatgatgagttaatgggtgtagtatattaatatggtatatgtatatatatgtaataaatttgtaggttgtgtatatgtattttagaatttaaagtataattaaaaaaaaaaagaatttggagaaattattaagtaagtattatatttaatgaatttatggtgaaattatgtgggaaaaatttttttgtatagggatgatgattttggaaatggtggagagagagatagaaaaataaatgttattgtaatataggtatttaaattgtatttaaatatatagatttttgaatttatagaaaatttttaagtatgaaattgattttatgtaatttaaagttttaaattttaaataattttttgtgttaaatttataaattgtgtattaatgtaatttaaatttatttttaaaaatattttaattaaaggagaaatttttggggtttgagattagagttttaggaaatgtatatatgggataaatttatataggttgaaattaagtgaaattttattttttaatgttgagatggattagttattttaatataaagtagaaatttttaagaaatgtagaattttaatttttttatttttattttatttattttatttatttaattagattttgtattttaataagatttatttagtgtaataatttttttatttattaaagttgagaagtataggattaaatgataaagagaaaagaggttgtttaggataaggaaataaaaggttgaagttaatttaagtattatgatatttttttagtgtgttatatggttatttgttattttttttttttggtttaatttgttttatggggatatttatgtgggaaaatatttttgtttttgtaatttatgtgggaaaatatttttgtttttgtgtttttatttaagtaaaatttgggttttttttatgttaattagtttttttattattgttattatgatagaaagtataggttatttataaatatgattagtttaatgagaatttttagaatattgttgatttaaatttggatatttatataattattaatttttattaaaatgttataaggtaatataagtataattagtttttttgatttttgaatatagtttaatattatttatttaattagaattatattggaaatgatatgattaattatggtaggtagtagatgtttagttatattagtattgtttttagttagatgtttttggtttttgtgagttttttttgtttttaatggtgaaatagtaatagagggaattaatttatttatttaaggtagattttttatttttagatttgttttgaaattaatagatttagtttttttttattaaatattatgaaatttaaataaatgaaatttgtaaaataatatagtagtagtagtaataataataatgaaatattaaaatagtaaatataagtattaaatattaaaattttttttttaattaaaattttttttttttgataaagtttttaggaggtaatttaatttttaggttggtgtttaatatttgggattatttgatttaagattgaagtatttaaaatggtttttaaaaaaggaaaaaaggttagatttttagagaaaagtgtaatattttttaagttgaatattatgagggatttgatgggggtagttttgtaagtagaattggagattggtttattgtttaggttttttatgaaagattgtaaaggttgtttgtttttaaatattaagaagttattaagtttattagtttaaatgtaaatgatttatattaggaattttaatagtgttgttgttaagttatttgtaaatgggtggggttgagatgatatagaattttatttttttaggtggtattttaagtatggttgattttatttttagttttatatttaaaagtatagtgtaaatatagttaagggattgttttttttaaattatatataaggtatatttattaataggagatgttgtgaaagttaggtggggttttgttttttaagtttttgtatttaagaataagtatgttgtgtataaaaaaaaaaaaaaaagtaagggtgatgtaattgtatttattgtttttaaagggagaatatgtaataatttttagatttaaggataaagggaatttttttttaagaaaagatgttggtattatgtggggattgggaatatgttagaataattatatatttttataagagagagaaagagaaaaaaagttaagatttatttgttttattttagtttttttttttagaattgatgattttaattaataggttatttttagagtattgttggatattttgattttttgttatgaaatgttatgggaattttggtagttgagagttaatattttattagatattagtgttgtataattatatttttaatagattttagagttgtggtgatagtatgttttttttagtttttttatagatggtgtttttgaaattttttatagatagtgtatttttgtggttaattagttatttgagtaatttttattatagaaagagtatttgtatataattaaatttattttaggattaaattgttgggttttaatgttattaatttagaagggttaaaatgaaaatgagatgaataatttttatttgatgaagggattgtattagattagattttattttttgaaatatatatagtattaaatttaaaaaaataagagagatgaaaataggtgatggaagaaattggaaaggtaagttgtttttagagattaaagaataatatttttttttaaattattattaagaaattttgggggaaagataaaattagtaagagaaggttattagttttttgttatttatttttatgaaattatttttagggattagtttgttaaattttattgaaatgtggaggtatatagtatagttttttttttgggatgtatagttatgttatatagaagtgtgtgggtagatgttaaaatatgtgtggatttgtaattttttttgtagaaatttagtattttgagtagtaataaggattaattttgtgtatttatggagaaaattggtggttttatatatttagttgttttttgggttatttttgtattttattttataattttttttaattatttaattgtaaagtataggaaagtgtttattatttgtagtttaatgtaggaggaaatataattgaatatgtttttttagttattgttttattttagtttttagtttttttgaagtgttatggtttattttaatagtatgagtaaggtagtttttaggttttgtgtataatgagttatgtggattttatttaagaaattggttgtattttagaattattataaaatataaggaaaatattaatattttagatgataaaagatttatatggttggttagaaaatatttgtattatttaagttattagaatgtatttatatggaaatatttaatttggtggtattgtgaataataggattgtgaaaatatttgtttatttttatttgtttttattaaatattgatttttatagaagatatgtaaatttaaatattaatatattttatttaagtataggatagggattttatttttatatagttgttataataaatataatatagtatttgttggtgataggattttggaagatgttttggatagttggaaaaataagtaaaatgtttttttttgtattaaatttgataaaaaataatagttaatatttattaatggtgaggtaaataatttgattatttattatttatagttgaggaaattgaggtttagagagttttggtggattttttaagattatatatttattatgtggtggagagggaatatgaattagtgttggtttgttatgtttttttttatatggggttagatatagatgtggtgttttataatgtgagggaggtttatttggtagaaatattttgtagattttatatgttagttttttatttatttaaataaagttttatatgagtatttttgataagtagtttgtttatatattaattttatagaggttaaatataattttaatgtttttttgttgttattttgtttttagtattgaattattattataaggtattaattatatatgtatatttaatagggtattttgttaaaattatgtatgaaggttatttgtttgagatgttagaatatttttttgtgagaagattttattgggtattgaaatagaattatatgttttttagattagtaattgtgattattaaatatttttttgttaattttatttgagtaagaatgtttttaattaaggtttaagtgttaatatgtttttaaaaaaaattgtggtgatataaaatttttttttttagtatttaatagaatttttttaaagttttgtggtttgatattttatgttatgtgatttgtgatttatttatttgttatgttttttgggaatgtggttaaggggttaagatgtgatttgaaaagaaaggtagaataagattattttaaatttattattaaggaatagtttagaaaatgattttagattatagagatagtagaatagatggtttggtatggatagagtattagatatttatagattgtgttaataagagttattgagttaaaatagttaaaggaaggagggttatggaatgggtttttttatattaaattgatgtttagaggtttttagtatgaataataaaggtaattagatttataagttatattgagtggatataaaatttatatttaggttgatattttaaatgtgtgtggtaagttagatgatgatggtataaaagatagaatattttgtttttggttattgttagtttttggaagagagtatatttttagaggagtagttgtaaggagtttgagaataaaattggaaatgtttgttatgaaagtttttataggtattattaataaaagaaaatgtttatttgttaatggtgttttagttagattttggtagtttatttttatgtttaggaatgattttttgtgtagattggatatagttattaatgtaattgtttaggtgtaatttttttataaaggggaagaggagtgatttttttttatatagtggttttgttaaaattttataaaaaatattgtttatttaaattaaataattattgtgtttggttttatttattatatttttttatgtagtggaattgaaggggatttttttttttgttgtttttagagaaaaataagattaagaattaatttttttaatgagaatggtaaggagttatgtggggatgatttggaatatatgttgtttaaatggtggagatgttatttaggttgtaaattatggtatttttatatgattttttatttgtttaatgtaggaaattatttggtaattttaaggaaaaagtttagtaataatgtattatagtttaatgtttatattgtatttggatagtttaaatttattttataaagtattaattatttaattataaatgttgagtaagtgtaaaattattttttaaaaaagtattttttgagtatgaaagttttaagtttagtaagatatttttgtgatttgggatatattttttgaatttagttttgaaaataatgttaatagttgagaaaagagtattgaaagttttatatatagtgtgttgtagtgaaataattttttttttggttttaaaaaatattgttgtgttttttagatttagtatggttagttagatgaataatgaatgtatgtttaattttttgttataggaaattttgtaagtggtaatgtgggtttattttgtgtgtgttattagagttggtgtaagtttatggttatggtgaggtagtgtttttattggaattaatttgatatttgtattagtttttgtaattgtgtagtgtttttattgtaaattatggatggggtaaaagattgtttattttttattttttatttaattttatatattttgtttgatgaggttatggagaaataggtttttttatatattaaaggtgggagtataaataatttaagttttgtgtaggataattaggtaatatttattaaaattatatatgattttttttgttgatttagtaattttatttttgggaataattgatagatataggtgtatatgtataaaatgatggaaagttttttggtatatattagtaagtgataaaataaggtgtaaaatagtgtatatatggttattattttttgttttaaaaatgggggaaaatggtggagtttgtggtgagttgagattgtgttattgtattttagtttgggtgatagagtgagattttgttttaaaaaaaaaatagggtggggtgggggggaaataatagtatatatttatatttatttgtatttatataaaatatattattaaggatttataagaaattaatataaatgattattttatagatggtatgtattgggggatattgaggtgagtagggtataagtggggtaagattttttagtgtaaattttttttaaattttattttgatttttgaataatgtaaattaattgttaaataattaaattaaaaataattaatttattaataaaatatttaatttagtggttttatttttgatataagataatttttaaatttttattaattattaaaaatagagatttatattagtttttttgtttgttttttttggtaatgattataattaagaagttttgtgggtgttattttagttttggagatatttttttagaagaaattgatttaaggtgggataattgggtatagagaatagtttttgggattgggggttgaagttttgaattttggttttgtttaatttttattttttattaagttgattttgtgaaatggttgatatatgattattttttattaataaattagataaatttatgggtgattaaatttaaaaattttgttgttttattattgtaatatgatgaggatatgtatatatattttgtttaatttatagtattatattagggattgttaatatatgggaaagagttttgtatattgtaaaggttaattttataaatagtagttgtgaaatataatataattttgagggggtggttatggttaaatataggaggggaaaaggatttagttttaaaagtatttgagatattgagatagtgtagaggaatgaaattttttaaaagatggaatttaaatataaatagatattaagagtgggttgatttgtagtggaagatgtggttaaatgattttatatgtggttatttgttattgtatatattgtaaattttgtgaagtttattaagggaaattagggagatgtaattgggagtgtattgtaaagatattgatatgaatatgaatgtgagattaatgttgaatgatggatttaaaaggatggtttttagtttttgtgaatatatagttgttggagatatgtgtttgttatatatagataggtttttaatttatttttgaaattagatgtaaattttaaatatttttgaaaagtttttttagaggattttttatttttaaatgtagagattaaatgaaaaattattttttaaaaggggttaaaaaaaatatttaaaaaattttttttttttatatgtatagttatttggaaaatagattttttattaaatggatggttaaagttgtattataatattaaattaagtataaaaatttaagattttttttttttatttttttaaaatgaaatattttaataggttagaaataattttatgaggaagtttattgaaggtatttttatttggtattattatttagatattgggttaggaaattagttatttggaatttagaaaaaataagaattattttgattaggtaaggtttttgtgtaaggtgtttagttttagttgggttttagtagtttgatgggtgttatgtatttttggatttttttttaatgaaataagggattttgattttgggttttatgttgagaagttttgaagttaaatataatggttaaatataatgtttttttatttttagttttatagtagattatgtttttatatagaaatttttttaggaggtttattattttatgttattttaagttgaggtttttttttatataagaggtttaaattgtttgtaagtaagaattaaagatatgttatattttttatgaattagttatttatttatttagtaaaggttattaagaaggtattgagtttggatgtattttgttttaggaaaattatttttaaggttgttttatgtaaagtgggaataattaatttggtaatttaatagatttgttaagtgattgttttaagtttaaattgttattgatttgtaagtatgatatgaaaattagagatttaaggaggtgggtatatttttatttgttaatagtttttaagagaagtgttttagtattattttaaatggttaattttgtatggttaattatttagttagaggtttataagattaaaaataatttttaaaaaattatttatgtgaataaagggataatgagttgatatttttaaggtgtatgttaggggtataatataagtttttgttttattagtagagttttggttgtttagttgaagttgaaagttagaattagttgtgtttttgttatttttttatatgaaaagaatttagttgtagatttttattttatgagaaaatattttttaaaaatttataaataatttttaggttttatttttgtttttgttttttttagagttataaaggttatttaaatttttgtggtgaggttatttaggagagttttttttttggatgttaatttgttaaatttgtagtttagatgagtgtgatgtagttttttaaaatttatttttgtattatttttttaaataatagatattttttgagtataggtattgaggatattaaaatgaatgagattgaatttttgtttttggggattgtagtgttaagggtgggttagatttaaaaattaataatatagtgtaatgtggtatatgttgtaattaatatgtataaagggtatttttaaaaaagagaatgaaaagagggaggaaggtggtaaaggagaaaggtttttggtttaagtttttgtttaataaagattatattttgtagattaaaagattatatgatttgttaattttttagtatgtatagtttatgaagtaagataaagtatttatgaagagtttaatattagtgagtttttggggtaagtaagttggaaattataatttatttatggatatttgtttagaattgattttttatttagagtgtttttttagttgataagaataatattgaaattttttttttttatgagggaaaaatatgttgaattatttagtaagtatttatagagttatttattatgtatgtgtttagtagtttattgtgtgttattaggagtaagaaaatgtagaaatatttttgtttttaaagggtttataatttaattgtagaaataatattaaaatatatgagaggaaagaaaagtaaatttagtttttttgggataaggattatattttatgtaatttttaaaaagttattatttatttaattttttattattattatatatttttggtaattaattattttttttttttttttgggattttgaattgggaatagaatagaaataagttgttaaataagaattaaaatatagggttagttttaattttagtgtaagtggtttattgttttggtttataggttttatagtttagaagatgaaagattaaggattttatttattagattaattttttttttttttatagaaagaataagtaatggggataagagaagggtttagaatatttttttgaaagtgttatttattaggaagtaagtttttttgtggaaatataaggatgggggaaagggattttttttaatattgttttatttatatatagagaatttaagtaatttgtttaaaattatagagttagtaagtggtgaggtttaaattaaatttgattattaggtttaggaatataggtataggttggggttgttttatgaagtgtttgtttaggaaatgtgtttttaaagttaatagattgttttgagtaggatattttagaatatttttttagataaaaatattatatttataatttttagtttagaatttgatatagtaaagatatataataatgttttgttatataagtgtatatataattaattattaaattatgaggtatagattatttaggaatttagatagggtaggtttattattatgggtaagagtttttttagaaataggattttagttaggttttgaagaatgagtagaatttagatgaataaatagtagaaaaaattattaataaatatatgagatttagagaattataataaaatagttttagttttgtaaattttgttataaagtgaagtatatttaggtatgaagtatgttgattaaattttttattgttttaatataagtttaaaaaaagtatttttttgggggagttggaaagtattaaaaataaaaatagtggttgaaatttattaagtatttattatgttaagtattgttttaagtattttatagatattaatatatttaatttttattaatattttgttgagaggttgagatatagagaatttaaattattgatttaaggttatagatttagtaagtgttaggtttggagttaaatttgatttttttttggtttaggaatattgttttaggtttttgtttttatttggaagtttttaattagaaaatttattttaagttagaataaaatttttagtagtttttttattttaaaatgtttgaatttttgattatttataaggttgtaaattttttttagttatgttttaatgtaagtatttggatagtgaaataaatgataagtttttttaaattataggatatttagtttatttgattttagtttagtgatttttaaattgttttatatatttaaattatttgtagaagtttttaaatttaatataggtttagggatttaatattaaatttataaattttggagattaagattttatatgtatatatattttaaagatttaagggtaattttgatgttgaatgtgtttgagaattattgttgtatgttgtattttattttattgtattttttttattattattattataataataataataatatttttaagttttggggtatatgtgtagaatgtgtaggtttgttatttaggtatatagatgttatggtggtttgttgtatttattaatttgttatttatattaggtattttttttaatgttattttttttttagttttttatattttgataggttttagtgtgtgatgttttttttttagtgtttatgtgtttttattgtttaatttttatttatgagtgagaatatgtggtgtttggttttttgtttttgtgttattttgttaagaatgatggtttttagttttatttatgtttttgtaaaggatatgaatttatttttttttatggttgtatagtattttatggtgtatgtgtgttatattttttttatttagtttattattgatgggtatttggattggttttaagtttttgttattgtgaatagtgttataataaatatatatgtgtatgtgtttttatagtagtatgatttataattttttgagtatatatttagtaatgggatggttgggttaaaagatatttttggttttagatttttgaggaattattatattgttttttataatggttgaattaatttatatttttattaatagtgtaaaagtgtttttatttttttatatttttttttgtatttgttgttttttgattttttaatgattgttattttaattggtataagatggtattttattgtggttttgatttgtatttttttaatgattagtgatgatgagtttttttttgtatgtttgttggtagtataaatttttttttttgagaagtatttgtttatattttttgtttattttttgatggggttgtttttttttttgtaaatttgtttaggttttttgtagattttggatattagttttttgttagatggatatgttgtaaaaaattttatttattttgttggttgtttgtttattttgatgttagttttttttgttgtgtagaagttttttagtttaattagattttatttgttaattttggtttttgttgttattgtttttggtattttagttatgaagtttttgttatgtttatgttttgaatggtattgtttaggtttttttttagggtttttatggttttatgttttatgtttaagtttttaatttattttgagttaatttttgtataatgtgtaaggaaggggtttagttttagttttttgtaaatggttagttagtttttttgatattatttattaaatagggaattttttttgtattgtttgtttttgttatgtttgttaaagattagatggttgtagatgtgtggtgttatttttgaggtttttgttttgttttattggtttatttatttgtttatgtattagtattatgatgttttggttattgtagttttgtagtatagtttgaagttaggtagtatgatgtttttagtttgtttattttgtttaggattgttttggttatatgggttgttttttggttttatatgaaatttaaagtagttttttttaattttatgaagaaagttaatggtagtttgatggggatagtattggatttataaattattttgggtagtatggttatttttatgatattgattttttttatttatgagaatggaatgtttttttatttgtttgtgtttttttttattttattgagtagtggtttgtagttttttttaaagaggttttttatattttttgtaagttgtatttttaggtattttattttttttgtagtaattgtgaatgggagtttatttatgatttggttgtttgttattattggtgtataggaatgtttgtgatttttgtatattgattttgtattttgagattttgttgaagttgtttattagtttaaggagattttgggttgagatgatggggttttttaaatatataattatgttatttgtaaatagagataatttgattttttttttttttatttgaatatgttttatttttttttattgtttgattgttttggttagaatgtttaatattatgttgaataggagtggtgatagagggtatttttgttttgtgttggtttttaaatgaatgtttttagtttttgtttatttagtatgatattggttgtgggttttttataaatagtttttattattttgagatatgttttattaatatttagtttattgagagtttttagtatgaagggttgttgaattttatgaaaggttttttttgtatttattgaaataattatgtggtttttgttattggttttttttatgtgatggattatttttattgatttgtatatgttgaattagttttgtattttagggatgaagttaaattattatggtagataagttttttgatgtgttgttggatttagtttattagttttttattgaagatttttgtattaatgtttattagggatattggtttataattttatttttttgttgtgtttttgttaggtttttgtattaggatgatgttggatttataaaatgagttagggaggattttttttttttttattgattggaatagttttagaaggaatggtattagtttttttttgtatttttggtagaatttagttgtgaatttgtttggttttgggttttttttggttggtaggttgttaattattgttttgattttagaatttattattggtttatttaggaatttgatttttttttttagttttaggagggtgtatgtgtttaggaatttatttattttttttagattttttagtttatttgtatagaggtgtttatagtgttttttgatggtagattgtatttttgtgggattagtggtgatattttttttattattttttattgtgtttatttgatttttttttttttttttttttattaatttggttagtattttatttattttgttaatttttttaaaaaattagtttttggatttattgatttttttgaagggttttttgtgtttttaattttttttagttttgttttgattttagttattttttgttttttgttagtttttgaatgtgtttgtttttgtttttttagtttttttaattgtgatgttagagtgttgattttagtttttttttgtttttttttgtgggtatttattgttatgaattttttttaaatattgttttagttgtgttttagagattttggtatgttgtatttttatttttattggttttaaataatgtatttatttttgttttttttttgttatttatttagtagttatttaggagtaggttgtttagtttttattgtagttgtatggttttgagttagttttttaattttgagttttaatttaattgtattttggtttgagagattgtttgttatgatttttatttttttgtatttgttgaggagtgttttatttttaattatgtggttaattttagaataagtgtgatgtggtgttgagaagaatgtatattttgttgatatggggtggagagttttgtagatgtttattagttttattgggtttagagttgagtttaaattttgaatatgtttgttaattttttgttttgttgatttaatattgatattggggtgttaaagttttatattattattgtgtgggagttttggtttttttgtgggtttttaagaatttgttttatgaatttgggtgtttttgtattgggtgtatatatgtttaggatagttagttttttttgttgaattgatttttttattattatgtaatggttttttttgttttttttgatttttgttggtttaaagtttgttttattagagattaggattgtaatttttgttttttttttgttttttatttgtttggtagatttttttttatttttttatttttagtttatgtgtgtttttgtatgtgagatgggtttttagaatatagtatattgatgggttttgattttttatttaatttgttagtttgtggttttttaattggggtatttagtttatttatatttaaggttaatattgttatgtgtgaatttgattttgttattatgatgttagttggttattttgtttattagttgatgtagtttttttatagttttaatggtttttataatttggtatgtttttgtagtggttggtattggttttttttttttttatttagtattttttttaggagtttttgtaaggtatgtttggtggtgataaaattttttagtatttgtttgtttgtaaaggattttatttttattttatttttgaagtttagttggttggatatgaaattttgggttgaaaatttttttttttaagaatgttgaatattggtttttatttttttttggtttgtaggtttgtagggtttttgttgagagatttattgttagtttgatgggtttttttttttgggtaatttgattttttttttttgttgtttttaatttttttttttgtattttaattttggtgaatttgataattatatgttttgggtttgttttttttgaggggtatttttgtggtgttttttgtattttttgaatttgaatgttggtttgttttgttagtttggggaagtttttttggataatattttaaggagtgttttttaatttggttttattgtttttgttatttttaggtatattaatgaaatgtaggtttggtttttttatatagttttatattttttggaggttttgtttttttttttttattttttttttttttaattttgtttttatgttttattttattaaattgatttttaatttttgatatttttttttttgttttattgatttagttattgaagtttgtgtatgttttatagagtttttgtgttgtgttttttagttttattaggttatttatgtttttttttaaattagttattttagttagtaatttttttaatttttttttaaggtttttagtttttttgtattgggttagagtatgtttttttagtttggaggagtttgtttttatttattttttgaagtatatttttgttaatttattaaatttattttttatttagttttgtttttttgttggtaaagagttgtgtttttttggaggagaagaggtattttggtttttggaatttttagtttttttgtgttggattttttttatttttgtggatttatttatgtttgatttttgatgttggtgatttttgtatggggtttttgtgtggatattttttttgttgatgttgatgttatttttgtttgttagttttttttttaatagttaggtttttttgttgtaggtttgttggaatttggtggaggtttattttagattttgtttgtttgggtattattagtagaagttgtagaatagtaaagattgttgtttgtttttttttttggaaggtttgttttagaggggtatttattagatgttagttagagtttttttgtatgaagtgtttgttgatttttgttgggaggtgttttttatttaggaattatgagggttagggatttgtttaagaaggtagtttgttttttagtagagtttaagtgttgtgttgggagatttattgttttttttatagttaataggtaaagaatatttaagtttgttgaagttgggtttatagttatttttttttttaggtgttttgttttatgagatgggagttttatttataagtttttgattggggttgttgttttttttttttagatgttttgtttagagagggagaatttagagaggtaatttggttataggggttttgttgagttgtggtaggttttatttagtttaaattttttagtggttttgtttatattgtgagaggaaaatagtttatttaagttttagtaatggtggatgttttttttttgattaagttggagtattttaggttgattttaggtagttgtgttggtagtgagaattttaaattagtagattttattttgttgtgttttatgggggtgggatttgttgagttagattatttggttgtttggtttttagtttttttttgggggagtgaatggttttgttttattggaattttaggtgttattggggtatgagaaaaaatttttgtagttaattgggtgtttgtttaaatggttatttagttttgtatttgaaatttagggttttggtggtgtaggtatttaagggaattttttggtttgttggttgtaaagattgtaggaaatgtgtagtatttgggttagatagtattgttttttatggtatagttttttagggttttttttggttaggggagggagtttttttgattttttgtgttttttgagtgaggtaatgttttattttgttttggtttattttttatgggttgtatttattgtttaattagttttaatgagatgagtttggtattttagttggaaatgtagaaattatttattttttgtattgatttttttgggagttgtagattgtagttgtttttatttgttatttggttagttatttaatatttttaattatttatttagtaagagttttaggtttaagtaaaattataattaagttattaaggaataatatattaaaagttatatatttatttttttttttaagagtttttttttttttaaaaaaattaaattaaaaaattttttggaaaaaatatttttaatttttttattattattttattttttggtatatagaagggtattagtttttgttggagataaaggtggatagtaggttagggtgataatattagtttgtttttgttttaggttttatattaatgtattaagggtaagatatggttttttatttgaatattgtaggttttggttatagatagttggagtggtggtaaggggattaggttaggtgaagttattgggttattatttttgttttggttttatagttgtgtattttggattgttatttagtttttttaagttttagtttttttttttgttatatagaaataatgtttgttaattttttttatagagttatttgtaggattaaatggaatgagatatgtgaatgtattttaaaaatgtatggaatattatatatttggataagattattattgaagtgtgtaattttgtttatatgataagtgaaattatgtaggaattgtagtaataataaattagttgaattttggttttagtattaatgtttattggggtattgtagtagagtaagtttttttaatattttatggaatagtgatagtgaaggtttttttaggtttttatgtgagattgtttgaagagtaattataggttttggaataatagatgttattaagtttattttattttattattattttttattttattttaagttttgggatatatgtgtagaatgtgtaggtttgttatataggtaaatatgtgttatggtggtttgttgtatttattaatttattatttaggtattaaggtttgtatgtattagttatttgtttgtttgttttgatgtattttttttttttttttgttttttgttttaggttttagtgtgtgtggtttttttttttgagtttatgtgttttttttgtttagtttttatttatgagtgagaatatgtagtgttaggttttttgtttttggttattaagtttaagaaagttattgttagggatgtgaaaattagaaaaataatttggtattttaggaaaagtatttaaaataaattgtattaatgatattatattttaatgattaataaaatatttgataaggtaattttgtattaatatttaattatttatatatgattatttttaaatattatataatgtaaaaaaatttatatgtttaaagaagtatttattttattaggtattatttgtgaatatttttaataagtaggtgaatataatttttaatgtaagtgaatatatatagaaatgggtagtaggatggttatttgtttgtttgttttgtttgggagtaaaagagaaggttaggaatatggttgtaggtttggtattagaagaaaagtgggatttattttgattttttgattttgtgatttttttttttttttgagatttatatatatatatatatataaattatgtataagtttgtttttatgttgtatagtaagagtttaaatatttttgagttaatgatgttaaattgtgttttgattatattagtatatttatatgatttttgaatattatatatagatttttatattatatatttaagtaaaattattttttgattttataatgaaagagatttattggattaaaaagtggtttttagtaaattttaaagagatattgttattaaattattaaatttaaaggtaaaatagtatttattaaattgatttttttgttttattttttttatttggtataattattaattaatttttagtaaatggaagtatttttataatttaagtttttttagggggaaatatataatttataaatattgttaagtgaagaatagatttttgaatattaaaagatttatgtatatttttgtatgtaaaaaaaaaaaaaatttattataaaattatagatttaaatattatttttgatttagtagttttttttttattgtggtttttgttatagagttattgttaaaaagagttttttatgaaagatttttatatagtaaaatgttttaagaaaatgtttaataaatatttttattgttttaatttgtatataaattgatatttgaaaattagagaggataaagaattttaatttttaaaaaagagaggtaagttattttaaaatgttattagttaataattaaaaatatagtttgggggtaagaagttttgaaataatttagagaatttgtttaagattttatttttggattagttttttttgggagggagtatgtgaataggtaatgaaagttttatatgagagagttaatggagagttatattaaggagtatttgaagatatatggattaatatagggaaaagaaatttaagtagtttagtgtttgatatttattgggtatttaattaatgtatggtgaattaataaatgaattaatgaaagaattatttgttatatataatatttttattttaagaaaaaagaatttgaaatagaagaaaatatatatgtaagaatatatataaattataaattatatgatattttaaaggagatgtaaatattaaattgtttgttttgttgattgatattattaatatttaaaagtagtatgagagattataaagaataagtatttatttatatttggagtgggttgtttattttatggtttaatttgtattttatgttatggttatgttgtttaatttttagttgttttatagaagagtaaaataagttataaataaattattaaagaaaaaaagtaattttatttatgttgaggtttgagggagttgggggaggagttaattttttttagtttatatttaaaaagagaaattttttggaaaattgtaatatttgaagattttgtggtttttaaaagtgaaggtgaatggtgagaagtttttttagtttagttattgaattttaaaaaaatataattttaaaagttaattttttaagtaatttgggtatttgaatttgataagaatttttttttttagatattttgttttgtttaatttaaaggaaaaatagttaattttgagaatttgtatataaataaggaaaagtaaaatatagtgttttgtaaagaaatgggagggatttttgatatttaatttatgatgttaaatattttaagtagatgatttaaaggtagaaatatataattgtttttattaggattgtttatggattataaataaggagtagatttatggttaatgtattagaaaaaaataagtataaaggtattttagaaaatattttattttaattttttattttagtgttatttttaaaagggttttattttagtttttttatttttttttttttttttttttttttttttttaatggggttttattttgttatttaggttgaagagtagtgggataattatggtttattgtagttttaattttttgggtttaaatgattttattgttttagttttttaagtagttgggattataagtgtttgttattaggtttggataattttttttgttttttgtaaagatggggttttgttatgttgtttagatttgtaatgattttttgggtttaagtgatttttttattttagttttttagagtgttgggattataggtatgagttattatattagattttttttttttttattatatatttttttaataaagtgttttgtatgtagtgagtatttaatatttgttaaattaaattaatggaaagttttttaattattatgtagagtatttaaatttatattattggttttagaattgttgtttgaagtaatataaattatatttatgatagtttgttaaatttttgaagtttatttttaaaataaggatgttaaaaatatattatatatgttgatattttaattttttagttatagtaggtattagtaatttgaatgttatttttattaattttttatagttttagaattttttttaatttaatatttaaaaattatttgttattttagtttaagtttttttgtttttaagttatgtattttaagtttttttaattattgtttatatgtaatgtttttaaattttttatgtattttggttatagtgatttgaatgtatattaatttattgatgatgtatttaaaataatttattttatttttttgaattgatgataatattttagatatagtttatttaaaaagtgaagaattattagtttttttattttagtattatatttttagtagtgtagtttaaaattttagtagttatgataatagttttttgttatattattggtttatattgaatttgtagttaatttaaaatatttaagttttttttttataatttgttgataagttattttttaaaattgtgtttgtaattttttatttttttttaaattgatttttttgtatttaattatagtattttatatttaagtaaatgtaaatgatttagattttattatttaatagaatgtttgtaatatttgttggttttatgttttatatgataagtatattgtttgtgtttttagatatattattagttaatatgttggtgttggatgtatttttttaatgttgtataagaggaatatttttgagagtttggtttaggaatgtggtttgggattttgttaagtatttttttttagtaaaatgattgtaaattttttgatttttagattttatatgatgtaaaagaagtttgtttgtgtttaaaaatatatttaagaaataagtgaatatgtgaaaagatagaaaaatttgttttaatttgggtatagttttagtttttaaaggtatatgaaggtagaaagaaagaattataaaatggaattattgatgatagtaattttaaaattaagattgattagattaaattttatgtggtaaaaattttatttagtaagtttttttttttttttttttttttagatatatgtgtatatatatatatgtatttttattttagtaattttttttttttgaaaaagaaagttttttgtatttgattgtttttatgaataatataaagtataaataatatgattttttttggttattatgtaattttttttttgtttattagaaattggtataaatttaagatatattatattttattttttgaagtatagttgttggtatttttattggtatttaaaaatttgaagatatttaaaagaaaatttataagtttatagttgttgtttaaattaattttaatattttatatatttataattttataagtgaattaaattatatataagaaattatagaattaagttaattaaatgatttttataataggtattggggaaaaatattattaaatttttttttttaatttttgttttttttttagtaagataaattatttttatgaagtttttgtttatattattagtgataatttgaagtagttattaattaatttattagtgtatttagtaatatttattaaagtgtttttttagaattgttttggatgttgttgtgggtgtatgtaaaaatgaattaaatatagatttttgttatttaagaattttaagttaatttgtaattattggtttttggttttataattttttttttttttttttttggtgttggtttagatgtatatttttatttattttaaggttaaggtaatttttataatttttttttttttttttgtttgtttgttttttgtgtgtgtgtttaaaattttgtttatatttgattttattttatttttatattttttgagtatattaaagttaaaggtagattataaattgaaaatatttttaaaggtttttttatttaaattatttggtgttattgtattttagaaagtataatgaattgtttgtagtaaataaataaaattagaatttttatatttaatggtttggtttggtatatatttatgaaaataataaatgttaaaaaggatgttagttgttgatttttggtatgttattttatatttggttatattataatgttaaaaggatttagtgtatatattaaattgtggatttgtttgttttaaaattttatttgtaattttatatgtaatttttatttttatatatatttataagatttgaatatggtaataaggaaattttagtaattgtagtgttggaaaaatggtttatatggaaataagttatttggttagtaaagttggtgattttgttttttaggtggtattattattttaatttttggtgagttgtttaaattatttggaattgtttgtttattttttttgaatttttattttataaattttaattttatataagttagttgtaattaaatgataggttgttttttaggttttattttagtaagttaatttgaagtttagtgattttttattatataattttatgtttttttattatattgttttagttttaagaaatttttttttgtttgattttttttttttaaaaatgtagaggtatgttaaaaatatagagggttgttataaagtttttgttagattaaaggaattaagatgaaagtatgtttaagagttattaggttttgggagattttaaaattaggatattattattatgataattaatgaaaagtttttttaagtgaatttttggggaaaattatataatgttttttattttttaggttttttggaaataaatttttattttattatggttgttattaaagtttgtaaatttattttgtttttttttaattgtttttttgttttatatttagttttttaatttatttaatgtaatttatttttaaatattaatttataaatgagatattagggtaatgagttattttttagtatttagtatatttgataagatttgttttattaagaggataagtgttttagagtttttatttgaatttaaatatttaatttaaatgaaagtttttatatttatttgattagatatttaaatttttttatagaaaagagaatatttttttgttttatttaaagaatatatatatttattattttttttttttttttttgtaaaaggtttttaatgttagtatattagtgagttttattttgtatttgttattaataatgattttatatagttaataattgggtttatgatttttttaaatttttatagtgtaaatattttggaaatttagtgaggtatttaagtataaaattatttaggattaaataattttatgttttaagtagaagtttaagaggatgtttaggatatatatgattaagtttataaatattaaagttattttatgttttttaggtttaaatattatatgtaaataatatatggattttatttgttagtattatttattgtttaatattattttatattaaatagagtaaatggatgtagagtgtaattagtaagtttgtttatttatttttgaagtttatttgtgtatgttatttattttaataaagaaaatttattataatataatttgatgtgatttttgtttaaatgatttttttttttattgaataatagttagtatttaaaatttagaattttatagaattttttttttgatttttttttaaaatgtaatttatagtttgagattatagagtttgttagtggttgaatggttgtattagatggttgagagttttttaattaagtaataattttgtaattagtggaaattgagtgttttataataattgtttgaaaataagttgagataagttagtaattattttataaaagggatatatttatttttgttggataggtgagattttttatataaattgaatttttttatatagggagatgtaagttgaaaattaatgttttaattattaaaattaaatttatattatgggtatttgaaatgggagtgtttttttttttaaaagatatttagagtttagttattatttattttttatgttgtttgtttttatttaggaagtttgaaattgtttttttgtattttgggattaattttttatattttaaaatgttaataaattatttgaatatgatttttttattttgtaaatttttttaagagtaagtttatgattgagatttaaagttgttggttgtgttatattttatagtttatagttttttttttttttttttttttttttatatatatgtgtatgtgtatgtatatatatatatatatatatagagagagagagagagagagagagagagagagtattttaggttttagaagatgaatgtaaaaagaatgtaaataagttttttgttatattattaggtgggtgtgtttagtttattgtgtgtgttgaattataaattagtgttatttatataagaaatgatattaattatttatattttgattattgaaaagttgggatttttaaagattttaggaaaaagggaatagtttatatttttatggtgttttttttaaataggaaatttatggattttgagttaggattttagaaatttgtatttttttttttataggatttttttttttggtgagttaaaatgaataagaaatattttaggattttttttttttttttggttattaatgagatgaaggtaattaatttatatagtataaatgaattatttgaggtgatgattgtattttaggtaaatgatgatttttttggttttattggtttgtaagtaaaagttatatatattgaaaagatattgaaatagattttttaaatgttttattttttggatgtattaatgttgatttattatatatgttaaatggttttaaaatattattttaaaataaaggaaatttttagttattaatttagttttgaatgggttatgaaaggttttaaaggtatgtgaaaaattattgttattttgttttaaaaaatgtgatgtttaagagtgtttgtaatgttttaatgttttaaaatatgtatgtaagttttgtttatttggaaattatttttttttgtttatattatttataaatagaaaatgttttgtaataatttaaaatagttttatatatataatgtttttagtgttataatatttattattggtttatatttattaatatttattatattttataaaatgaagtagaagaaaaaaaagataatgattttatggttttggaattttagtaatggtgattaatatgttttaaattttagtaaaggttatggttatattttaataagtgtttttttttttttttttattttttttgttaatttagaggtaaattttttaaaaaaaaaaaaaaaaaaaaaaaaaaaaaagttttaagtaaggtatttgtaaaattagaaaataggaataggagtttagtgattgtttttaaaaggtgttgtttttagggttaaaattttgtggtgtaattttaatatgttatgttatttattatgtgtaatgttttgaaatgttatatgttataatattagaaatttttaatttaaaaattatgttgtatgagataagtattgaaggtatatatgtttatataaattaaatttgtaattatgttttaataagttaaaatgtaaagatatattaaattgtaagattaaaatggtttttgattttataataaatttatataaaaatagatttttttataataataaaggggagagagagattttgtaggatattgagttagtagggaggggttttatttaatattatgttgttttttatatgtagttagaaaattaatgtttttaattatatattattttgttttaaaagattattaggaggattaataaatatttagaaatatgtttttttttgtttttggttaagaatatttttgtgtgtttgttggaaaatgttttttggttgttattgatattaaggagtaagtgtaggataattagaggattttaaaataagatttaagaagttttaatatattgttaattgaggtttattaaagtttttttagtgtgaggaaaatttgtatagaagttaaataagaatgaggagttaaaatttattgatgatgagttgtatgttttattgagttggagttagtagtattatttaataagttttttttattagttttttaagggattttgtaaaatttttttttattatttttttatttttagttttttgtttttagtagttgtttttggtagtatggttggtagagggtattttttattttttttagttttgttttttgggttttttttttttttttgttttttttttattttggttttttatttttgttttatttttaatatataaatattgtattttttagtttatttttgtagttttgaggttttttttttagggatgtttttagtttgtaatttttttttttttttgtttgttaggtatagagtttttaatttttagttatttttttttaggagtaatttatttatttatttttttttttggttttgtatttttagagattaatttgagttaagaattttttatgtatattttaattattttttgaaagttaaaatttttaatttttttggagggtgttttagaagaggggtgtaggatgggtagagatgtgggtttggtttgtttgagagtgttgtagatttttttagtttttagtggtaggaattttgttttttaagttttttaagttatattggttttggatttgtaagtttattttagttttaatttttggggagtaggtagttgtgtgtagttttggggaagggatgtgggttgaaggtgtaagttttttttttattttttttgtaagttggtgtggggattatttattttttggaaggatttttagtttagttttagtattttttttttagttaggatttttgatagttttggttttttaagttttttttgattatttttgggttgggggagggttgtgagggatttttgggttgttgtttttgtttttattatgtagttttgggttttttttaggtttttttttttttattttgtgatttttttgggtttttttttttttggtggtgttggttgattttttgggttgtgggatgggggagaaaattttttaagagtaattttaaattgttttttttattggaggggaggaaagaaggagattggttttgttttataattttggggtgggggattttttagttaatttttttttgtggatgggtagtttttgtattaagttttatttttagtgtttgtttattttggggtttatataaattttatgggtttttggtggtggagttatattgtggttttgattttggttttagtgtttagttttggtttttgttgtggtgttgttttttgttggttttatagtagtggtgggtgttttattaaagttttttgagtaggaggtggaggggtgtattgggttggtttttttgtttggtttgggagtttgaggtgttatggggtgtgtgggatagtgagtgggtgggtgtgtttgggtgtggtggtggtagtgttggggatttggagttttaggttgtgttttgtgtttgggttagatattatttagttttttggttgagttttgattggttaaatggtgttgtttttttttttttgttttttgttttttgttttttgtttgtttgtgttattgatatttgtttgaggtggttgtttaaagggaatgttgtgttttttttttgtgtggggaattgaggggtgtttggaattttttgtttttttggggtttgtttttatttttttttttagggttttgtgatattgttttgtgagttttgtgtttttttggggtgttttggataggatgtttgtggttttgaggggtgttttagttttagttttagttttggggaattttgtgttttgtgttttttgtagaaattttggttgtgggtgttggggtgggagggagtgagtgagaattgtatgttttgaggttttgtttttttagtttttaatttttttttttttttttattttagtatttaagttttttgggagagggtgtgtgttttttgggttatagatatatttttttgtatttttttgtattatggagtttgtgaatgtgagtatataatgaaattgtatagagtatgggggttattggtttattttgttgttttaaatatgttggtttaaatagagtttgtgtattgatttttttagagtttgtttaataggaatttaattaagataataatagtattttttattgatgaatgtttttagataatgttatattaagttatttgttttagttaggaagtttaggtaatgatagattttgttaaagttatatgttttttagttgattaaatagaaaaatggaaagagaaagaaagaaaataaatttatttttttagttattatttgttaaagtaattattaaggtagttgttttgggaaagattttggttttaaaatttttatattttattatttttttatgttttttttgtttaattaaaggggggagggggtgtgagtttttggtgtttggtatgtattttttttgttttgtagtaaagaagttaaattattgatagtggaaattgtatggtggaggtaatatttgtattttattagtgagaagttttatttgattttggtagaggtagggagattttatgttagtttgttggggggagtggtagtgagagtagttttttttgtggtgaatgggaaagtgggtgggagtttatgagagggttttatggtgttttgatgtgtgttgttatatgatatttttgttgttttgaaatagatattttagtgtatgaattattagaattaaaatttagtgtatttaaaatgatatattttttattagaagagttttgttttagggtattgtatgtttttgtagatgtttttatttttagttttagtaaatatatgtataagttaatttttttaataatgaattagggtagttaagataaataaaaagttttttgttttaattagagtgggggtaggtgatttgagggtgggggtagaattggtttagttaatttttttttgttttttatttttattattgtttgtagtaaaagagtaaatagttttttgggtttttatttgtttgtagttaagatttttgaagagaatttatatggttagggtttagaggatatttttaattatttatttgatgaattttgttaattgtttatttgtgtttttgttttaaagttgaattttttttttattagtttaattaatttgtgtagattttaaaatttagaataaagaataagatagtagtattgtatttaatttggagtttttggatttttttggagtataaaaattatttgggtgagtgttaaaatgaaggtttttttttttgaaattgtgatttagtaggggtggggtagggtttaggagttataattttaataaatattataagtaatttgaatgtagataatttgaagttatattttgagaaatatttttttgggggtataatattgggtattagaggaattttttattaagtttatatttaaattttgtaggtagttttttgtgtgtgtgtgtttttttgtaattttaaaggggtttgatttaataattgtgaagattattgttgtaagaatttttttaaagattttaatattaattttgttaaagggaaagatttataaatagtttttttttttggatttttttgtggttattaagaatgtgttgttgaattgaatatataatattattatatatttagtttaatttatttaagggtttatagttagtaaaatgaatttattaatattagttattttagaatttttaaagattagtgatagaaattatttatttgttttataaaagaagaatttgattttttgttaggaaataatttatttatgtttatatagtgaagtattagggataagattttagtgaatttaagaatttttgttagaaataattttgtttttattttttttattttttaagtgaagttatttgttttttggaagtgttattagaatgtgtgattatttagagtgtttttgtaaattgttggattaaatagttaaattatttaaatatatgtatattttttgagtgttatatatttagttttgtatttttgttaatttgatagagtatatgattaatataaattattttatagtatagatggtagagtttattgtggaatatttaatgtatgtgaaatatgtaggttaattagaaagtaataaaggatagagggtatgaagttggatattgttattttatagattttttgtgttggtttttaggttgtaagatgaatgtaggtataattttttttagtagtataatataatttaaaaggttagtgttatatatttaaaaaaaatatttgtattatattataaaggattggaggaattttattttaaattttaattttgttaattttaaattgatgttttatatttgtttgaaaatgagttttatttttaggtttttaagtttaattgtaatttattttttttttgaaaaaatatttggtaagttaatgttaggaatttaagttagtattttgaaggttgtttatttagaagttatggtaaattttttttttgttaaatttatattggtatgttagtatttttgttgaaggaaaaagtgtttttattttttagattttgattgggtgggtttatggttaatttttttatttttatttttttttgatattatataaataaatgtgtgtatttttgttttttagtgtgtggtgtagttttattgaggaaaagatagaggagttagaaatgttagggatatttagaaagaaaagaagattagatgttaatttagataattatgatgaattatattttttaatatttgtaagtatttttaaattttttgatttgtgattatagtattgttaatattgtatgtgattagtttaaaatatgtatttatttgttttaaaagtatattttatatttaaaaataatgaagttaagataaataaaattgtattagtgttttgtatggaattttaaatattattttttatttgtttaatttaggtagtatatagagataattttggaggtttaaaattaaatattttataaaattatttttttattgtgggtaaggatgatgttgagaatatagagtatgtattttttttttttttaaaaattggtttttggtataattgatatgttaggagtaaagtttttaagtttataatttgaatattttttttattattaaaatgagggaaagttttatagtttgaaaaaataatgttatttattttatttttgtggggtttaaaaattaattgtgaatttgtttgaatttttatttttttttggttatgttttaatatgattttaatttaatgttttagggggaataaaggttaggaagaaatttgaatttttatttatttttgttgggaaatataaattaatttttattatttaagtgagaatagaggtagtaggtttgatattgatatgttttttttattaataattttaattggttgaggttaattttattattataagtattttatatttatgtttatttaagttttttagttatttttatttttagtattttttgtaagaaaaaaaaaataagttgtttagtttagtattaaataagttggtttaaaaaaattgttgaaattttttgtaattagtatagggaaaatatttagtaaatagaaaattttgttgttgagtagagtggtataggtgtttttaaatttattttggataatttgaaaggtttggtttaatgttaaattatgttatttgtaatttttgaaatttttgtatgaggtttgttttgagaaaaattttaagggagaagtaatttttttatttatgagatgttatgtttttattaagttttttatgaattataagaatagtttaatattatattaaaatgtgtttaaattggttaatatttgttataggagttatgtaattaggtatagttattagtggtagataaaagaaaggaattatagtaagaaatttttagaagggttaagattaggagagtagaataagagggttaaaagttgattttatttgggaataatatttagttggattaagaaaaatggtatagaaattattaagaaattgttgagattaaatttttaaatatatgagaaatattaatttgtagttttttaagttattagatttgtgttgagaatatttaaaaattaataatgaagaataaatttggtttatttgttgtaatagttttataagtgtggttaaaagggatgtgagattgtgggtataagttagagttgatagtaataaatagttgtggtattagttggttttgttaggagaaaagttatgagaagaattaataaatttaaattaaagggttttaggatattgaattagatgaaagatgaatattagtttatttttgagatttatttatttaggttgtgtgatgtttggagtgagagattttttatagttaaattttaaattttttatgaaaaaaatgaaaaagaagaatatgtaaaaataatttagaaaaaaataagtgaattttttaaagttttattttaaaaatatatattaagaatttggtttatttttatgtgattttgatatatgaatttataaagtattttttagtggtttttttgattaaggatttgagtaggatgtgtaattggttttttttttatttttagatagtataggtatggtgagaatgaaatttttaatagtgtatggttgtgaagaatgggttaggttttagattagtttggtatatagaattatttggaaatatttgaaatttttgatttttttaattttagttgttttttattttatagttatagttatttagttgatgaaagattgttgagtatttattatttgttaggaggttattttatgggttgatataggtagatgtataaaatatattttagttttttatatgtttatattttaggatataagagttgtattttaatttatggtgatatttgtaaatttgttaagtttaggaagttttgttttgttttatttttttttgttgtaggtttggtgtgtagaaagatgatggtaaatatgtttttagtggttagggggtggtagtgatggataagaaatttgtttttaaagttggagtggtatttagaggtgggggagggtttattatggttaattagtttttagttattttggttagtagtgttttataaaaggtagataaaagagaaggagtggatagggtgagagggaggaaattagataatttttgtttgaggtaaataatttttttaaatatgatagatagatttataaaagataggtttagaagggattttaagagattattttattttttttattatttataggtttgttattgtagattagggaagtagattatatattttttttttggggagttatttagaatttagtaatgttggtgtttggaagtttttatttgtaatgtatttttgtttttgttgtaatttatattttattttattttatttaattttagtgaagatggagaatagttgtttattaatttttttatgttattaagttattatttagattttttttgtagtaaaagattagattttataatttttttttataaattttaatttttaatttattaattattttttttggtttattttggattttttttaagatttttatatttttttgaaaatgtggagttttaaattagatatgtgtgtgaaattatttagggtttaggaaatataggagttatgaattatttggatatagttgttgggaaaaattaaagggaagatttaattagattgataaattttttttttgtaatttggagataaagtagtggttgtttaataaaaagatgagtttttataataaagttatgttttttgtttttagtttttaaatgaagtattatttttaaaagaaataatttttgaatagaatatttagtttttattgtttttttttttaataaaattgtttaagaaatagtggtttttttgtattttatttaaaattttaagttgtagattttttatatttaaattggatttgtgtttttatatttttaggtgtttattatatattgatataattttttttaaaggtaaggtttatgaaatattatattatttttgaagttttattttttatttaaattgaattatttttttttatttggtttgtatataaaatttagttagaataaagtgaataaaattaagttgaatttagtaaaagagaattatgttaatttatatgatatttagaattaagtttttataaatttattaagtatgtttttattatggtttaataatttaatgagattaaattatgggattagtagaaatattgtttttattatttaggagatattttatggtgtttgtaaaattagtttaattggtttaagaagatattaaattagatatagaataaagttagtattttaaaaagaaatggggtagtagaggagaatgtttattttttttttataatattgttttgagaaattgtttagggattttgtaattaaaaagagattgttgtaagtgtttgttgtaagtaggtatttttgaaattttagttagttagtgagaggtattaagaagttataagtttagttggatataggaaaggttgatgttgatatagaagaataggataaatataatgttttataaaagttgaagatagagagatggggtggaatggggaatgaattggtgagagtatagttattaatttaaattttagtttttataattgttttttgtttggttggttgttattgttatgtatgtattttgggaaattatttttttttttgttgtttggatagtagttatgatttgggaatggggggtggtgtgtgtgggaggtgaggtattatatggttagatatttaattttggaagttagatgttgatgttatgatttagattaaatatatttttgagatataaattaagattatagttagttttttttaagatagtttttatgttgaattagaaaaatgaagattaatattttttttattattagattttatgtgttttttaaatgtagtaaaatgtttaatattgaggattttttattttataggtatgtttttttgaaggttttgagaagaatgagttaaatatatgattatttattggtttttttaatttaaataagttttaagtgtaaataatttaagttagttttgtattgtttgtttttttatgtttatattaaatattgatttgaattattatttttatataatatttttatagtattataattagattgtggatgtagattatgttagaattattttgtaagttaaatttttattattttttattttgtttgtatataaaaattaattagagtaaagtgagtaaaaataagttgaattttataaagaagaattatgttaatttatatgatgttaatttattttaaaagtatgtataagtttgatatatttttgattattttttagattaatttttttttaatttttttttattattgtatttttggaaatttatattgttatttatatgattttgttttttgtttttagaaagaatttataaaatattagatttatttttaattaattgatgtttataagagtataattttagaagagtagtaataaaagttaattataaaagtagaattatatgtatggatattatatgaggaataaagaaattgttttaaagagtatttagttggaatataaggtggttttaaaaataaaaattttaaatgagtaaatattttttaatgttttaagagtagggatattaatagatataattaattttagaatttttttttttttttttttttttttttgatatagagttttattttgttatttagattggagtgtaatggtgtaattttggtttattgtaatttttgttttttgggtttaagtaatttttttgttttagttttttaagtagttgggattataggtatgtgttattatatttggtttattttttaagttttagtagagatggagttttattatgttggttaggttggttttgaatttttgattttaggtgatttatttgttttagttttttaaagagttgggattataggtatgagttattgtgtttggttagaattttttttttattttttgattattttagggaaaatatattagtagttgttgtttttttggggtggaggattaggagtgaaaagaattttgttgttgaaaattaaataaagttgttgtttaattttagataaaagaattaaatgaagtaattttgaaataagtaataatataggaattaatgaaaatttgaagttttaagttttagttagtgttttaatagttataaagtaattataggatatttaagaagtataaagtataattagttttgttttattattttgaaattaataatatttgattagaatgttattaaagtgttgttatgtttatgttttagtaataatttgtttttaattttattttgaatattaaagtaattaaaattttgtataaattgtttattgtttttttttgatgtgattattaggaaatagaagaaatatttttgttatatgatattattttaaggtttagatagtagttaaaagaattttggttttaatttaaaattgttagtttttggttatgtaatttgggtaagtaattttattagtttaagattgtttagatagatattgtaagggttatataattgtttattgaataaattgagagatttattattgtgtattttagttgtttaattaattaaatgaggttagtgggttataaattgagtttgttaaagttggtaatatatttagattttattttagaaagaagagatgatttaggtgattttaatgtatgaagggaattagtgaattagattatttgtaaggtattttttttatttaaatttgaatgataagtttagtttattaaatgatatatagtttttgagttaaggtaaggatttatagtttattagttattatattatttagttatttttgataaagttttaggtggatttttttatatattaaaatgttttttaagattatttttttttgttaggttgtttttagagttttgggatgtattaaatttattatgtgtttatggggtttttttttgaataaattagagtggaggtgggatgaagtttttttatagatttttgtatttttgattatttatatgtttttggtagttttgtaaagattattgatttgtgtgttaagatatattagtatgtatttaattttttatttaaaattatatttttttaggaggtgttttttaggaggaagatggatgaaataaatgtattaggaagatgtttaagtagatatgttatttttttatttagaatatattttagtttagtttttagagttagtatttagagttttgagttggtgtaaagatataaaggatttagatattaatttttggtatgtttttaaatgagatgttatttttaggaaagttttaagtttggagtggattttttggaggaagagtattgaattgtataaggaaagttaataaatattttagtttttaatagggattataagttttgtaattatgttttagattgtgtttgtttattttttttttttttatatttgtaaataatatgttagttttggaggtttgttatttattgtgtgtttttggagagggtgttttttattatagtatttgtagtattatagttagtaatagtttgtaaaggtaaatttatgaaatagtttttaaatatattaaattttaatttaaataatttataatattttttatttaataatttttagaagttaattaatttggaattgttttaaataagttaagaaaggagttagatattatttattgggttaataaattaaagtggaaggaagaatatgtaggtgaaaagttttagattttaatttttttagtgattatatatttatgtttggattattttgtattttgatagtgttttaagtgtgatgataattataataataaaagttaagattgaatagtgatttgtagattagtgattaaaaaaagggttttgatattagatagatttaggtttgaatttagttttgttatttattggttttgttaatttaagatagttaattaattattgatgttttagtttttttatttttaaaagaaaaataattgttttagtttagaaagattgttgtgaggatttaatgaattaaggaaatgtagaatgtttattatagtgagtttaataaagttagattttattattaatgtatatgattttaataaaatattgtaatattgtttttattttatgattatgaaaattgggttttaaaaagggtaggtgataattagttatttgaaaattttttattggttagtaaagattaaaatgattttaaagtagtatttttggaaatgaattgtgagatttatggttattttaaagagttgtggttaagattttgtaagaaaatgtgtatgtaaattatttgataatgggagatttagattaaatttgggtggtagttataagatggggaggtataattttataatggattttggaattagaaaattttgggtttgaagtttagtttttttattttagattttttgtgttagtttgggtaagttatttaaattttttgagttttagtttttttaatttatttttgagagttattttaagagttaagtaatatatgttaaatataaaataaataatagtattggatgaatgtagagtaaatgttattttatattattataattttttatggtgtagtaatgataaataggaagagttttagtaattttttgggttagtgaggttagaataggtattttaagtaatgttgagttaatgattagaatttgaattttttattttttttaatggagtgatggattgttagggtaatggggttgtgttggtgatgttaaagataaatgttagagtaatagtaagtttagttaatagaaatatgtttattatattttggtttttttagtatttggttttttttttatttgatagtttgtttaatggtaaatgtgaattttaaaagtttttttttaatgttgatttttttttgttaggaaggaaataataatggttaatgttgatatttattaaattaatatttttgaatttatgttgtgttaataagtgttttttaagtgttttgttgttaaatatgtgtgggaaatgttatatagtagtatttgtatgtttttttattagtatatattatagatatttttatattatgttagttttatagatattttaaaatatattgatatttattattattttaaaattataatatttattttgttgttagattttatttaatgtattaaaaagtatatatattattatattatataatatattattttaaatgtttttataattgtatattaatgttattggttttttttgtaattttatatatttattttatttatttagaatttttttttttttttgagataaagttttattgtgttatttaggttggagtgtagtggttaattttggtttattgtaatttttattttttagatttaagtgatttttgtgttttagttttttaagtagttgggattaaaggtatatgttattatgtttagttaattttttttttttggtaaagatagggttttgttatgttggttaggttggtttggaatttttgattttaagtgatttatttgttttggttttttaaagtgttgagattataggtgtgagttgttgtgtttggttttatttagatatttttatgagaagggtttatataagttttattagattgttaagagagttgagtttatggtatgaaagttattatagtgagtaatttttttttttttttttttttttttttttttttttttttgttaggttggagtgtaatggtatgattttggtttattatagtttttgtttttatggtttaagttagttttttattttagttttttaagtagttgagattataggtatgaattattaattttttgtatttttagtagagatagggttttgttatgttggttaggttggtttggaatttttgattttaagtgatttatttattttggttttttaaagtgttgggattataggtgttagttattatattgggtattagagtaatttttaaatattgattatggaagttattggtaagtaagaagtttttagtggaggaggaaggtgaaagtagaagaaattattgttttttattaaagtagttagaataataatgagtatggaaggtagagaatagttaatttaagagtttttgtataattagaattttattgtgatttttttttttattttttaatttttttttatatttttttttttttttttatttatttatattgtaatgttttattttaaaggttttggatgtttgtgatatttttttgtaattatttaatttgtgtattttttttttatagtaattttgttatttagagataggaggtggttgatatatttttttgaagtgggaggaattaattttaattttttttggtattgatgagtatggtgttataaggaaatttttagatagtataatattataatatttattttgggaataaagattttagagtattttttgttgttatttaggaaaattgttggattattttttttaggttgtgaagattttggagtggatttaatatttatttaaaggttaaaaattttgataaagtatattttattttttgtagtggtttgggaaatgtttagagtggattaaaatgttttatataagttatagtttttttttagttttaggttgaatttttaaatttagaggttgtatgttattaaattgttggtttttagatattagattttaaagattttttatttttaaattaatattttgtaatatattttgttatttgtttaaaatagaatttaagaatgatgtttgttatgtttagtgtattagaagttattttaaatatgatatttttataaaagttaatagttgttttattaaagggtaattatgtttagtgtgggtggttgtgttaattgtttttgaattattgtagtaatttagttaattttagggaatggtttgtagtttttttatatttatatttttttttttaattatttttattaggttgagttagttaaggatagatttatagtattttttggatgttaaaatgtttatatattttttgtaatttttgggttatttgtttttttttatgttttttttggtttgtttatttaattatttattattatgtgtatataatgtattatttatgagatttaggtaattttaggatgtaatatttttgattttaaaaggaaatgatttgaaaaattataatttttgtttgtataaagaaaataagtagtaaatttgatagtaggttttttattgtattatttgtttttaaaaataatttgtagaaatttgagattattttttaaattaaaatttttttagttattattttataaatgaataggtttaatatttagattttttttattttgggtttaaatatgttattttgattttttttatgatatattttttaataagttaaaaatttgtggtatttatttagaattgtaaattattaaaggttagggtaatttaggttttaattttttttatattgtaagaaatagttatagattatattttttatattatttaaatttggaatggaagtggaatttagagtttattttgagaatattttttttgttttatgtgtgaggaagtagagattaagagtgattgattgatttttttgggtattgataagtggttggaagtaaagtttaaatttaggtttttaattttatttattgtgtttttttgaaaaaaggaattttatgagtttagaggtttgtttttttttaaggattggagtaaataaagagattagtttttgtttttaggttataagatttattaagatagggattatttggttttgtttgtttttgaatttttagattgtaatatagtttttggtatataatggtaaattatgtgttgttaattaatatttataaaataaaattatgaatgttagagtttttatagaaagtatattttttgggtaaaatgggaaatgattagttaagtttatgatttatataagtattagaatatttattaagataaataagtatttagtgtttaagattgggatgaaattttagaggattgaaataaaataagttagtatgaatttatgtattagatatgagttgggttaagtgatttttgagaatttttttagaatttagattttatgatttataagtaaaggtaatgtatattttggttttggttttttttattttttgtatttgttttttggggaattagtaattatgatttagatggtatgttaattagaggaagagttttgttttttttgagtgtttaattgtgggagagggaaatattgttttaggaagattagttaaaattttttattaggtttgaaattttgaaaattatttgtaaaaaatgtttttaatttaattaaataaattaaaataggagaaaataatgtttatagttttttttgatgttttagtggagtttaaggtagtatggtttagagaggaataaatataaatttttttaaaatttgaagaaagattttgagttagtttttatattttattggtagtgtagtgttagataattttgtattttattttttttatttgtaaaaggtgattggtgatttttattttatatgattgataaggaaattaaatgaaatttatagagagttgttaaagtattatatgaatttaaagtgttattattaggaaatataaataaagtttgtattatagtagaaaaattttttataggattgttttataatgttggaaagaaagtagaaaaaaaatttatttgaatttttaaaaagttagaatgaatattttaaaaattgttaaatgagattagaggtagggttaaagaatttatttttttttttttgtattatagtgttttaagggtattaatttttatgaaatatgtgtattttttttaaaagatatttgttaaagtagtagttttatattttaaagtaaaagaggaaagatgttatatttttgaaattataattatttttaagttaaaaaggggaaaaatttttttgttgaaaaatttaatttttttttaagatttttatttttatagtatttaatgatggtaagtttttattagatgttaatgtttatttttattgttaagtagtatgtaatgtttttgatatagattatggtatgtaaatttaagagatttattgtttgttaaatttttattagaaaatatatatagagatatatatgtttatatatatatatatatagatatatatatatatatatatatatatatagtagtagtagattagtagagaaagatattagttaaagaaagataatttgagatatttttgaggtagtagttgtaaaattaaaataagtaatttattaaattatttatagagtgaaaagaaagttgtaaaaatagatatttttttggtaagttagtgttttttagaataaatttagtttttagtagagtttttaaatttgatgatattagtttatatttattagagttatttaagtggttagattagtttgtttaattaaaattaaagagtagttttattggtttttgagagaagtatatttaataaaaaatatgtttagttagatattattttaattgatagattgtaagtaatatgattgagtgaatgttatttgagtaagtttgagtttggttttaaaattatagaattataaaataaaaattttttgtaagttatgttttaatgttggtttttttttatttttgttttttggttgattatttattttgtggttatttagttttttgtttttttttttgtttattgtttgattttggaatgttgttttttattaaagttttttttagaggataggttaggaaaaggaaagaaattaaatttattagtttttttttttattaagaatttagattagaaatttgatagggaaagagtttggtaaatgaaaggggaagtttatttatgttgattttagatttttaaaagttttttttttaatgtatattaatagataattgaaaaataatattttataagttaattaattatttgtttttaaaatttttatttattattttgagtatatatattagattatgttttaaaataattagtattttggtttagtgaaatgaaaatgatatgtgtaaagagaatgttataatgatattttttatttatggagtgtttgttttttagtttgtaaagtttttatatatatttttttttattttttaaaaattgttgtgttgtaggttttattattaatgatattgaaaaagttattggtaggatgtttatatttttatttgaattaatattggtatattttattgggggagttagattaagttaaaattttatatatagaaatattaatatgtaagattaaggggtataaaagtaggttaggttattgttaatttaatagtatttaggttaaaattttttttttttttttttttttttttttttttttttattattttttagttttttgattgattttaaataggataattgaaatgttttgtttttatgttgaagagttttttgtaaatatatataaatagtgaatattaggtgtattatttttaaagtgttatttatttttataatagtttaggtgaaattatgttattttataagttgagtgtgtgtgtgtgtgtgtgtgtgtgtgtgtgtagaggatgatgtgatatttttgaggtttatttaagttgttaaagattttaaggttataagatttagattgttaagtatttttttttttagagatatgaaatttataatttttttgatttaattgttaattaaattggtaagttaattaaaaggataatatttttttaatgatgtatttatttgaagttttagtaattgtattaggtagtagtgagtatttgttagtaagggatggtgtggggagagggaattttgtaatttagagtgatagatgattttttttttatttattaagttgttttaaaatgttataatatttatattttttttttggtgaattagaatttagagataagtagatagaaagaaaaaaataataattttggttggttgttgtttgattggaaaaagtaagtgttgtatttttaaattttgtttttttattttttgttttgtatattatttttttttgttttttttgggattttgtaataaattttttagttttgtgtttagttttgtagatttgtatttaaaatagtattatttgggaagggtgggtggtgatggtgatgtgggtgttttggagtttttttgtagtatgtttggaattgtattagattgattagaaatttttttgtttttaagtttagttttttttgttatgtttttttgtttgtttttttttttttttttttttgtgtagatttgattgagaaaatgattggattttggaataatttgtgttttatttgttgtaggtttgttttgtaaattttgttttatgttttttttgtgtgttgagtagtttattattgttatttgattttagtgtttgttttttattttttttttttgaatttttataatatttttgttttgtttatgaatttatttgtgtagagttgggatttttttttttgtttgttaaaatagtggttttgagttttggaaatagattttttttatgttttttttatttttattttaagtttttgttttttaattaagaagagttgattgggggaggagtttagaatgattaaattttggggtgaaaattgttattgggtttggttttgtggttggaataaaaggtttgagaagggggtgggggtgagggttataggagtgtggagagtttggtggtttttgtttaggggtgtttaagtttttgagttttttgaagagtggtaagaggataatgtagttgtgtgttttggtagtttgttgttttttgggggtgtaggtgggggtgggagaggtagaatataggtttgggtggttttgtgttgtttttattttatttgttaagttttttatttttatttattgttagttttttgtttatttgggtggtggtggtggtttagtgattagttggttgttttttattggtgtttttggatgtaattttgttttggtagggtggtttgtgtgtttagttgattggtggttttgtttagttgttgtatggagttaaaagtgtttttttttattgtttttagttgtttaggtttttttgtttggtttgttttttggttttttggtttggaaaggattttttatttttaggtggaggtttttttttttttgagttattttgattgatttggatttgggtttagtgaggtatttggtttggttggggagtggagtgtggttttggtagtttttttttttttgagaaagtgggaattttttaagttagtgtttgaaatttgtggggagggaggatagaagggaaaaaaaaaagaaaatttagaaagaagtatttagtgaggagtgagggtgatggagaggaagagatagaatgagggagggatggaggttggaggagggggtggggtggaagaaggggggtgggaaggagggagggagggggaaagagagggagggagggatatagagagaatgaattttttttattagaagagttgaaattattttgatttatttttttgtgttggaggtttagttttatttttttttttttttttaatttttattttttttttttattgtatattatttttattgtttgattttaaatgttataaagttaaattttaggaatttgaatgttttgtaaaagttttataattagtaatgaatttattgtatatatatatatatatattagtaaagagaatggaaaagagggaggtgaagaggagaaaaagagagataaattttatatttgaattagatatttgtaggtttaagttaattaaatttattatatttgtaggaagattgagttttttttttttttttttttttttgttttagggtttttatttagggtaatttaaattgggtaaatattaagaaataatttttttttatgttttttttttatttttttttttttattatgtgttttttttggaagatagtattaaaatagtttaagaattggggatgtaaggggtttttgttttggtgtttattttttttgtggtttatattattttggtggttagattttggagataaatatttgtattttttaaagttaatttagtatattaatttggagtttgttaagagtttattttagtttatattgttaggaagttaattttagtgagtttaatgaggggattaaattggggtttgttttttaaatgttttgttttaaaatttgattttttttttagttttgattttagtgtgagttgaattttagaaaagatgttttttaagggtgatatagggttggttttatagtggggttaagaagattatttgggggtattgttattttggataaatttgttggttttgtttaaggtgttgaatggatttttattgtttggattatatatttggtatagtaggaggaaaaggtttaaaaatttttaattaagtgatatttgatattgttttagatggttttttttatttttttatggtttgttatgtgtggatggttttgttaaagttattttgttaatagttgattatatgttgatgagaatttttttttttatgagaggattatttattattggtgatatgtatttttgatttatttttttttttttaattttattttttatttatatttaaatttttagtttttattttatttttatttttattttattttttaattttaatttttaatagtattattgtttttagatggaaattaatttttttgtaaatgttaattatatgtttatatataaattatagaatatgattatatattatatatattaaggaaaagaatagaatgtaagattgttgagagataagtattagttttgaataattaatataatatatatttttttatttagttttaagtttgttttatgtagttttatatagttgtgttaaattttaaatgattttaattaaagttgtattgtgtaaaaatttgatttttttggtttgagtagttgttgttttttggtgtgtgaagtgttaggaagagttgtgatatgtttgttgttaagtaatatgttaagattttttaattataatgtaggttttattgttatttattattgtgtttttgttgttttggagatttaagtgttttaaaattttgtttttttaatagatgttggaaggtaatgtgttttgtttgaagttattatgtgagaagtttggttttgtttagtggattgtttattatttggtgtgatttatgaatttaataattttttgtaatatttgtaagtttaaatttttaattattttggtgattatagaagataaagtaattggtattgatgttgaaaaatttatagatttatgtaaatgtttttattttgagagatatgtttttttttgagtttttatgtgattttaatgaatgagtgaggttattaatgattgtttaattgttttgttatgtagtaggtgttttttagggttgttttttaattgtttgttattgggttttggtattgaaagtttttagagaaagtgaggagttttagggtatttttgtaaaaaaaaaaatttagtttgtatattgtttttttgtttattatgtaggttatatttggggttttggtgaagttgaatttggtttgggagatttttttgttgttaggtaagaaaatttttgttttgttaggttagggtgggaagattgttggggaatttgttgtttattagtgttggtagattattgttttaataataatattagaaaagtgtagtagggagggggtggggggtggtaatggtgatgattaattttgttgtttatgtgattgatttattgtgattttttgggtaaaaaaaggaaattttttagaaaagtttgtgttttttttttttttttattatgattaagggtttttagttgatgaggttgtgagtgatgattaaatggggattggggggaggggggtgagtaagtgatttgtttttgggaatatttgtatgtgttgaagtgtgaattagtttaataatttttttttttttttttaggtattgatgattaggtgagaggtattaaggtgagttattagttgtttataggaatttgtgtaagttgagtttttgagtggttgagttgaatgaagttatgattgtgtttgttttaatgggttatggttttttaaatgtgagttaatagttttggtgtgtagttaggttggaaggtgagttgtggagagtggagttgtgggttaaggtagggatgggaggggaggtggtaggttgggtgttttgttgttgtttggtgttgtttttttggagttgtttttttattttgtgggggttgttttgttgttggggtgttggggtgagtgtggtgggagttagggttggggtggtgaattttggagggggtttttttaggaagttttgtggttagtgtttgtgtttttttattagtggttgtgtaagttgggaagtgaagaggttatgtgttggtggaaagtaatttggaggtgaaaggatgaattttgagaagaggaaaaaaagtataatgaaataaattatttttttggagtgtttaatagagggggaggtgggagggggggtggaggggtgttgttttttgtgggagatgtggggatgattttggaaattttgggaaataggtaataatttgagttttggtaatgttttttagtttagggaggtgttaatgtaaggtatttttttattgaagttgttttttgtttatttttagttattgttagtatagtagagtagaagaattagggatgaatgtagattagttgttatggagatgtttgttgttttgaggagtgttagtgttttgggaagtttttagatgtattttaggttttgttgttttggtattgatattatgattttatttgttttgagtttttattaaggggagtttattaatggtgttataggttttggttgtggtgttattgattgtagggatgaggtatagtgatgttgtagaagatggtggatagtttttaagttttagattatttagttttttttaatttttagtttttttattttagttaaaagtgttttgtttgaatattatttttgtttgtttatgtagaaaaattttatttatatgataggatgattagaagtaatagaatataagtatttagtggttgttttaaggtttttttttttttattttagaaatgttttttttatggaaaataagttttattttttaattatgtgtatggatttttgtttattgtagtttttattggtattgggttattattattagtagtaagtttagtgttgagtttatgtttttttagaaatgtttttaaagttaaataggtttattttaggttttagataaaatatttgtatataaaagttttttggtttttattaggagtagttttagatttgttaggtttttgga

SEQ ID NO: 229 - DNA, 68851 bp, Artificial Sequence
  Chemically-Treated DNA
tttaggagtttggtaaatttagaattatttttaatgagaattaggaagtttttgtatatagatattttatttggagtttaagataagtttgtttgattttggaaatatttttagagaagtatgaatttaatattagatttattgttaataataataatttagtattaatgggggttgtaatgaatagaggtttatgtatataattgggaagtaaaatttattttttataaggaaggtatttttgggatgggagagggaggattttgaagtagttattgaatgtttatgttttgttgtttttaattattttattgtgtaagtaagatttttttatataagtaagtaagaatgatatttaaataaagtatttttgattggaataaagaaattggaaattggaaagggttgggtggtttgaaatttaagagttatttattattttttgtagtattgttgtgttttatttttgtagttaatagtgttatggttagggtttgtgatgttgttggtgggttttttttggtgggaatttagagtgagtaaaattatggtgttagtgttaaaatgatgaaatttgaaatgtgtttggggattttttagggtattagtgttttttagagtgatggatatttttataataattggtttatatttatttttggtttttttgttttgttgtgttagtgatggttgagggtaggtaaagggtagttttagtggaaagatattttgtgttagtgtttttttaggttgggggatgttgttaaagtttgagttattgtttattttttgagatttttggagttgtttttatattttttgtggagagtggtgtttttttgtttttttttttgtttttttttttattagatattttaagggggtagtttgttttattgtgtttttttttttttttttaaagtttatttttttgtttttaagttattttttgttaatatgtgatttttttgttttttagtttgtgtagttattggtggggaagtgtgggtgttaattgtagggttttttgggagagttttttttgaggtttgttattttagttttggtttttgttgtgtttattttggtattttggtggtggggtagtttttgtaggatgaggaagtggttttggggaagtagtattgagtagtagtggagtgtttaatttgttgtttttttttttgtttttgttttggtttgtggttttgttttttgtggtttgttttttgatttagttgtgtattggggttgttaatttatatttgggaagttataatttattagagtaaatgtagttataattttatttaatttagttgtttgagagtttggtttatataggtttttgtgggtaattagtggtttgttttggtgttttttgtttagttattagtatttaagaggaaaagggaaagttgttgggttggtttgtgttttgatgtatgtagatgtttttaaggataagttatttatttgtttttttttttttagtttttatttgattattatttatgattttattggttggagatttttagttatgatgggggagggggaggggtatgaatttttttaagaagttttttttttttatttagagagttatagtgagttggttatgtaaatagtgaggttagttgttgttgttgttgttttttattttttttttgttgtgtttttttggtattattattaaagtggtagtttgttggtgttgataagtaataagttttttagtggtttttttgttttagtttgataaggtgaaggtttttttatttggtgatagggaaattttttgagttgaatttagttttgttggagttttaggtgtgatttgtgtagtgggtaagggagtggtgtgtaggttgagtttttttttttataggggtattttgaaattttttattttttttgggaatttttagtgttaggatttagtaatgggtggttagaaggtagttttaggaaatatttgttatatagtagggtagttgggtaattattggtaattttgtttatttattagaattatgtaagaatttaaaaggaaatgtgttttttggagtgagggtgtttgtgtaaatttataggttttttgatattgatgttagttgttttgttttttgtagttgttaaggtggttgagagtttaagtttgtggatattgtaaagggttattagatttataagttatattaagtggtgggtgatttattgagtaaagttgaattttttatatgatgattttaaataagatatattattttttagtatttgttggggagatgagattttaagatatttgagtttttaggatagtaaaggtataatggtgagtagtaataaaatttgtattataattgaaaaattttgatatgttgtttaataatgggtatattatggttttttttagtattttatatgttaaagaatagtagttatttaggttaggggaattgggtttttatatagtgtaattttaattggaattatttgagatttgatatagttatgtggaattgtgtggaataaatttggagttgggtgggggggtgtgtgttatattggttgtttaaggttgatgtttgttttttagtagttttgtattttatttttttttttaatgtgtatggtgtatgattatattttatgatttatatgtgggtatgtaattgatatttgtaagggggttaatttttatttaaaaataataatgttgttagaggttggggttagggggtggagtgggggtaagggtggggtaaagattgggagtttaggtgtagatggggggtggggttggggggagagaaataagttagaagtgtatattattggtaatgggtaatttttttgtagaagaaaaggtttttattaatatgtgattaattattaataggatggttttggtaaagttatttgtatgtgataaattgtaaggaagtggaagaaattgtttagagtaatattaagtattatttaattagagatttttaagttttttttttttgttgtgttgggtgtgtaatttgggtgataggagtttatttagtattttggatagagttaatggatttgtttgaggtggtggtatttttaggtagtttttttggttttgttgtaaagttaattttgtgttgtttttaaaaagtgttttttttgaggtttggtttatattgagattggggttggagagagagttagattttggagtggagtgtttggaaagtgagttttagtttggtttttttattgagtttgttgaagttggttttttagtggtgtaggttggaatagatttttggtaagttttgggttggtatattgggttaattttgggaaatgtaagtgtttatttttaggatttagttattggggtggtgtaagttgtaaagaaggtaagtattagggtggggattttttgtatttttaatttttgagttattttgatattgttttttggagaggatgtgtggtggaggggaggaggtagagggagagtatgagagggggttgttttttggtatttgtttagtttgaattgttttaggtgagaattttggggtaaagggagaaagaaaaaaaagaaatttagtttttttgtggatataatgagtttagttaatttggatttgtaaatgtttgatttaaatgtaagatttattttttttttttttttttttattttttttttttttgttttttttgttggtgtgtgtgtgtgtgtgtatagtagatttattattaattatgaagtttttgtaaaatatttgaatttttaaaatttgattttgtagtatttagaattaggtggtggaggtggtgtgtggtggggagaggaggtggaggttgggaagagggaaggaggtaaagttaaatttttaatataaaaaaatgaattaaggtaattttagtttttttagtgagaaggatttattttttttgtattttttttttttttttttttttttttttttttttttttttgtttttttttttttattttgtttttttttttagtttttattttttttttattttatttttttttttttgttgtttttgttttttgttggatgtttttttttgggttttttttttttttttttttttgttttttttttttgtgagttttgggtgttggtttagagggtttttgtttttttaagggaaggggagttgttgagattgtgttttgttttttagttgggttggatgttttattgagtttaggtttgagttagttggggtaatttagggaaaggggagtttttgtttgggagtagaaggttttttttggattgaagagttagagagtgggttgggtgagggggtttgggtggttggaggtggtggagaagaatatttttagttttgtgtggtggttggatagagttattaattagttggatgtgtagattgttttgttagggtgaggttgtgtttggaggtgttggtggagggtggttggttagttgttgagttgttgttgttatttgggtgggtaggggattggtggtgggtggaggtgaggggtttggtgggtgagatagaagtggtgtggagttgtttagatttgtgttttattttttttgtttttgtttgtatttttgggggatagtgaattgttggaatgtgtggttgtgttatttttttgttattttttagggagtttagggatttaggtgtttttgggtgggggttattaggttttttatatttttataatttttatttttattttttttttaggttttttgttttggttatagagttaagtttggtggtagtttttgttttagggtttggttgttttggattttttttttgattagttttttttaattaaaaggtaagagtttggggtaggggtgaggggaatgtaggaaaaatttgtttttgaaatttaagattattgttttaatgaatgaaagaaagaattttaattttgtgtaggtggatttataggtgaagtgaggatattgtggaaatttagaaggaaaagataaaaaataggtgttaggattagatgatggtgataggttgtttggtatataaagggagtgtagggtagggtttatggagtaagtttgtagtgaatggggtatagattgttttgagatttagttgtttttttagttagatttatgtgaagggaggggaggggaggggtgggtaggggagtgtggtgggaggggttgagtttgggggtggggggatttttgattagtttgatgtaattttaagtgtgttgtaaaggaattttaaggtgtttgtattattattgttatttattttttttagatggtgttgttttaaatatggatttgtagggttgaatgtagaattgggagatttattgtaaaattttgggaggggtgggggggggtggtgtgtggaatggggaatggaggagtagaatttaaaggtgtaatgtttgttttttttaattaggtggtaattggttggaattattatttttttttttttgtttgtttgtttttggattttaatttattaagaaagaggtgtaaatattgtgatattttgaggtagtttgatggatgggaaagaaattatttgttattttaaattgtagagttttttttttttgtgttattttttgttagtgaatatttgttgttgtttaatatagttgttagggttttaaatgaatgtattgttaagggaatattatttttttagttgatttgttaatttagttgatagttgaattgagaaaattgtagattttgtgtttttgggaggaaaaatgtttaatagtttaagttttgtaattttgaggtttttaataatttaaataaattttaaaagtgttatgttattttttatatatatatatatatatatatatatatatatttaatttgtaagatgatatggttttatttaaattgttgtggaaatgaatagtattttaaaaatggtgtatttgatatttattgtttatgtgtatttataaagagttttttagtatgaaggtaagatattttaattgttttgtttggaattagttagaagattagaaggtgatggagagaagaagggaagaaagaggaaagagagagaattttaatttagatgttattaaattaatagtaatttagtttatttttatattttttggttttgtatattaatatttttgtatgtgagattttagtttggtttagtttttttaatggagtatattagtattgatttagatgagaatatgagtattttgttagtagtttttttagtgttattgatagtaagatttataatatagtaatttttggaggatagaagagaatatatataagggttttgtaaattgggaagtaggtattttataaatgggaggtattattatgatattttttttgtatatattatttttattttattgaattagagtattagttattttaaaatataatttaatgtatatgtttaaggtagtaagtggggattttaaaagtaagtgattagttggtttataaaatattattttttaattgtttattaatgtatattggaaagaaggtttttaaagatttaaaattaatataaataagtttttttttttatttgttagattttttttttattagatttttgatttaaatttttaataagaagagaagttggtgaatttagttttttttttttttttggtttgttttttaggggaagttttagtaagaaataatattttaaaattaggtagtgagtgagagagaaggtaagggattggatgattataaaatagataattagttaagaaatagaaatgagggaaaattagtattaaagtatgatttataaagggtttttattttgtaattttgtaattttgggattaggtttaaatttgtttaagtaatatttatttgattatattgtttataatttgttagttaaaatgatgtttaattgagtatattttttattaaatatattttttttaaaggttagtaaagttattttttggttttaattagataaattagtttaattatttaaataattttaatgaatatgaattgatattattagatttaaaagttttgttgaaaattaaatttattttgaaaagtattgatttgttagaaaaatatttatttttgtagttttttttttattttatggataatttaatgagttgtttattttaattttataattgttattttagaagtattttaaattatttttttttggttggtgtttttttttgttgatttgttattgttgtgtgtgtgtgtgtgtgtgtgtgtgtgtttgtgtgtgtgtgtgtatgggtgtgtgtgtttttgtgtgtgttttttagtgggaatttaataagtagtgagttttttaaatttatatgttataatttatgttaagaatattgtgtattatttagtaataaaaataaatattagtatttagtgaaagtttattattattgagtgttatggaaatagaggttttaaagaaagattaaattttttaataaaaaaattttttttttttttggtttaaaggtgattataattttaaaaatatgatatttttttttttttattttggaatgtagagttgttgttttaataagtgttttttgagaaagatatatgtgttttataaagattaatatttttaaaatattatggtgtagagagggaaggatgaattttttaattttgtttttaattttatttggtaatttttggagtatttattttgattttttaaaaatttaggtggattttttttttgttttttttttaatattataaaataattttataagagatttttttgttatagtgtagattttatttgtattttttagtaataatattttagatttatatagtattttgatagttttttataggttttatttgatttttttattagttatgtaaggtaggaattattaattattttttatagatgaggaaagtaaggtgtagaattatttaatattatattgttagtaagatgtaaagattaatttagagtttttttttaaattttaaggaaatttgtgtttgtttttttttagattatgttgttttaaattttattagggtattagagggagttgtaggtattatttttttttattttgatttatttaattaaattaaaaatattttttataaatagtttttaaaattttaggtttaatggaaagttttaattagtttttttaagatagtattttttttttttatagttagatatttaaagaaagtaggattttttttttagttgatatattatttaagttatagttgttaattttttaaaaaataaatataaagaataagaagaattaaagttaagatgtatattatttttatttgtgaattatagaatttgggttttgggaaggtttttagaggttatttagtttagtttatatttgatatatgaatttatgttggtttgttttgttttaattttttggaattttattttagttttggatattgggtatttgtttattttggtagatgttttgatatttatgtggattatgagtttggttgattattttttattttgtttaaaaggtatattttttatagagattttagtatttataattttattttgtaagtattaattggtaatatataatttgttattatgtgttaggaattgtattataatttggagatttaagaataagtaagattaaatggtttttattttggtggattttgtggtttagagataaagattggtttttttatttgttttaatttttagaaggggatagatttttggatttataagatttttttttttaagagaatatagtgaataagattaaaagtttgagtttaggttttatttttaattgtttgttagtatttaaaaaagttaattagttatttttgatttttgtttttttatatataaaataaaagagatgtttttagaataaattttaaattttatttttgttttaagtttgagtgatataaaagatatagtttataattattttttgtagtgtaggggaaattaaggtttaagttattttaatttttggtgatttataattttgggtgggtattgtaaatttttaatttgttaagaagtatattatgaaaaaaattaaagtaatatatttgaatttagaatagaaggaatttaggtgttgaatttgtttatttatggaatgatggttaggaaagttttaatttagagaatgattttaaatttttgtggattatttttaaaagtaggtggtgtgatggaagatttgttattaaatttattgtttattttttttgtgtaagtagaagttataattttttaggttatttttttttaaaattaaaaatattatattttgaaattgtttgggttttatgaataatgtattatatatatatgataatagataattagatggataagttaaaagaaatatgaaaggaagtaggtagtttaaggattgtagaaggtgtgtgggtattttgatatttaggaaatgttatagatttgtttttaattaatttagtttggtggagataattaagaaaaaaaatgtgggtgtagaaagattgtaagttattttttgggattggttagattgttgtagtagtttaaaaataattggtatagttatttatattagatatgattgttttttgatgaggtagttattgatttttataaagatgttatatttaaaataatttttgatgtattaggtataatagatattatttttgaattttattttagataaatggtaaaatgtattataaagtattaatttaaaaataaaaaatttttaaagtttagtgtttaaaaattagtagtttagtaatatgtaatttttggatttaagaatttagtttgaagttgggagaaagttgtagtttgtataggatattttgatttattttgggtattttttagattattataggaagtaaaatgtattttgttaaagtttttaatttttgagtgaatgttaaatttattttaaaatttttgtaatttgggaaaggtgatttaataatttttttaaatagtggtagaaaatgttttgagatttttgtttttagagtgaatgttataatgttatgttatttagaaatttttttgtagtattatgtttattagtattaaaaggagttagaattgattttttttgttttaaggaaatatattaattattttttgtttttaagtaataaggttattgtggggaaaaaatatataaattaggtgattgtagaaaggtgttataaatatttaaagtttttgggatagggtattgtagtgtgagtgaatagagaaaagaaagagaatgtgggaaaaaattgagaaataaaaagggaagttatagtggagttttaattatataggggtttttgaattgattgttttttattttttatgtttattgttgttttggttattttagtaggaaataatgattttttttgtttttattttttttttttgttaaggattttttatttgttaataatttttataattaatgtttaagaattgttttgatgtttagtgtggtggttaatgtttgtaattttaatattttgggaggttgaggtgagtggattatttgaggttaggagttttagattagtttggttaatatggtaaaattttgtttttattaaaaatataaaaaattagtggtttatgtttgtaattttagttatttgggaggttgaggtaggagattaatttgaattatggagatagaggttgtagtaagttgagattatgttattgtattttagtttggtaaaaaaaaaaaaaaaaaaaagaaagaaagaaagaaagaattgtttattgtaatgatttttatgttatggatttaatttttttggtagtttggtaaagtttatgtaaattttttttataaaaatgtttaaatggggttaggtgtgatggtttatatttgtaattttagtattttgggaggttaaggtgggtggattatttgaggttaggagttttagattagtttggttaatatggtaaaattttgtttttattaaaaaaaaaaaattagttgggtgtggtggtatgtatttttaattttagttatttggaaggttgaggtatgagaattatttgaatttgggaggtggaggttgtagtgagttgagattagttattgtattttagtttggatgatatagtgagattttgttttaaaaaaaaaaaaaaattttaagtgaatgaaataaatgtataagattataaaggaagttagtggtattgatgtatagttataaaaatatttaaaataatatattgtgtgatatagtaatatatatgttttttaatatattaaataagatttaatagtaaggtaaatattataattttgaaataatgataagtattaatgtattttgaaatatttataaaattgatgtgatatgaaggtgtttgtgatgtatattggtgagaaagtatgtaagtattattgtgtaatattttttatatatatttaataatagaatatttgagaagtatttattaatatagtatagatttagaaatattaatttagtaaatgttaatattagttattgttgttttttttttggtaaaaggaaattagtattgggagaaaatttttaaaatttatatttgttattagataagttgttaagtggggaaaggattaaatattgagaaggttagggtatggtaagtatgtttttattgattgagtttgttattattttaatgtttatttttagtattattagtataattttattattttagtaatttattattttattgaaaaagataaaaagtttagattttggttattaatttagtattgtttaagatatttgttttgattttattaatttaagagattattgaaattttttttgtttgttattattatattatgggaaattataatgatgtgggatgatatttattttgtatttatttagtgttgttatttgttttgtatttggtatatattatttaatttttaaagtaatttttagagatagattaagaaaattagagtttagagaatttaagtaatttgtttaaattaatatagaaaatttgaagtggagaagttaaattttaaatttaaagttttttggttttaaagtttattatgaagttgtgtttttttattttatagttattatttagatttaatttgggttttttattattagatggtttatatatatatttttttataagattttgattataattttttgagatggttatgagttttataatttatttttaggagtgttattttagaattattttgatttttgttaattgatgagagatttttaaatagttaattgttatttattttttttgaagtttagtttttataattataaaatggaaatagtattataatgttttgttaggattatatatattaataataaaatttaattttgttgagtttattatggtgagtattttgtatttttttagtttattgaatttttataataatttttttaggttaagatgattattttttttttaaagataaggaaattgaggtattagtaattaattaattattttaaattagtagagttaataagtggtaaagttgggtttaaatttaggtttgtttaatgttaaagttttttttttaattattaatttgtaaattattatttaattttagtttttattattataattattattatatttaaaatattattaagatatagaatgatttagatataagtatatagttattgaagagattagaatttgaaattttttatttgtatgtttttttttttattttagtttattaatttaatggatgatgtttgattttttttttaatttgtttagggtagttttaagttagttgatttttgagagttattgagtaagaaatgttataaattgtttggattaggatttagtatgtttagaagttattttataagtttgtttttgtgaattgttattggttataatattgtagatgttgtgatgaggaatattttttttaaagatatatagtggatgataaatttttaaagttaatatgttgtttatagatatggagaagaagaggatggataagtatagtttaaaatgtaattataaggtttatagtttttgttggggattagaatgtttattggttttttttgtgtaatttaatgttttttttttaaaggatttattttaaatttggaatttttttgaaaatagtattttatttgggagtatgttaggaattggtgtttgggttttttgtgtttttgtattaatttagaattttggatattagttttagaaattaagttgggatatattttgggtaagggagtagtatatttatttgggtatttttttgatatatttattttatttattttttttttagagagtattttttagaaagatgtggttttaaatgagggattggatgtatattggtatgttttagtatataagttagtggtttttgtagagttgttaaaggtatataagtaattaaagatgtggaagtttatgaagagattttattttatttttattttgatttatttagggaaggattttatgaatatataatggatttgatatgttttagagttttgaaagtagtttagtaaaaaaggataattttgaaggatattttgatgtatgaaaaagtttatttaaagttttgttagagataattaagtaatatgatggttggtagattgtaagtttttattttggtttaggaattgtatattatttggtaaattaaatttgttgtttaaatttagatagaaaaagtattttataaatgatttagtttattgattttttttatgtattgaaattatttaaattattttttttttttgagataaggtttgaatgtgttgttagttttagtaaatttagtttgtagtttattgattttatttgattgattgggtaattgaggtgtatagtggtagattttttaatttatttaataaataattatatggtttttatgatatttatttgaataattttgggttagtgaagttgtttgtttaggttatatggttagaaattgatagttttaaattaggattaaagtttttttgattattatttgggttttaaaataatattatatgataaagatattttttttgttttttaatagttatattaaaaggaaataatggatagtttgtgtaagattttagttattttaatgtttaaaataaaattaaaaatagattattattaaaatataagtataataatattttaatagtattttaattagatattattaattttaaaatggtaggataaaattaattatattttatattttttaaatattttatagttattttatgattattgagatattagttaaaatttgaaattttaagtttttattgatttttatattattatttattttagagttattttatttggtttttttatttgagattggataatagttttatttgatttttagtgataaaattttttttatttttgattttttattttaagaaaataatagttattaatatattttttttaaagtgattaagaaataaaagaggaattttagttaggtgtggtggtttatgtttgtaattttagttttttgggaggttgaggtgggtggattatttgaggttaggagtttgagattagtttggttaatatggtgaaattttgtttttattaaaatttaaaaaatgagttaagtgtggtggtgtatgtttgtaattttagttatttgggaggttgaggtaggagaattgtttgaatttaggaggtagaggttgtagtgagttaagattgtgttattgtattttagtttgggtgatagagtgagattttgtattaaaaaaaaaaaaaaaaaaaaagaggaattttaaaattaattatatttattaatatttttatttttaaaatgttagaaaatgtttgtttatttaaaatttttatttttaaaattattttatattttaattaaatattttttggagtaatttttttgttttttatataatatttatatatataattttgtttttgtgattaatttttattattatttttttaaaattgtgtttttataaatattagttaattaagagtaaatttgatgttttataaattttttttagaaatagagagtaaaattatataaataataatatgaatttttaaaagtataataataaaaaaaaattagaaaaaaattaatttaggaaatagttaagaatatgttaaatttgtatatatttttgagataaattggtattatgtagattagtatgatttttttttatggaatttaatttatttttatttattttgttttaattagtttttgtgtgtggataagatggaaggtaatggaaatttggtttgtaaagtagttttaatatgatttatatttataatttggttataatgttataagaatattatgtgggaatagtagtttaaattagtatttagtatgaatataaagggataaataatgtaaagttaatttaagttgtttatatttggaatttatttaaattaaaaaggttagtggatggttatatgtttggtttattttttttaaggtttttaggaaaatatgtttatgaaataaaagatttttaatattaaatattttattgtatttgggggatatatgaaatttggtaataaaggaagtgttggtttttatttttttaatttagtatggaaattattttgaggaaaattgattatggttttagtttgtgttttagaaatatatttagtttgaattatggtgttgatatttgatttttaaaattggatatttagttgtatagtattttattttttatatatattattttttatttttaggttatgattattgtttaagtagtaaaaaaagaagtaattttttagagtatatatatggtagtgataattaattaaataaaaaataattataggggttggaatttaaattaatggttgtatttttattaatttattttttattttattttatttttttgtttttaatttttatgaaatattatatttgttttatttttttgtattagtattagttttttttatatttaattagatttataattttttggtgttttttattggttgattaaggttttagaagtatttatttatagtaaatatttgtagtagtttttttttggttataaagtttttggataattttttaaggtgatattatgaagaggaagtaaatatttttttttgttattttatttttttttagagtgttaattttattttatatttggtttaatgtttttttaggttaattggattgattttatagatattatagaatattttttgagtaatgggaataatatttttgttgattttatgatttggttttattgggttgttaggttataatggagatatatttgatgaatttatgaagatttgattttaggtattatgtaggttagtataatttttttttattgaatttaatttagttttatttattttattttaattggattttgtgtgtagattaaatgaaaagaaatggtttaatttaggtgaaaggtaaagttttaaaagtagtgtagtattttatagattttatttttgagagaaattatattagtatataataagtatttgagaatatgaaagtataaatttaatttaaatgtgaaaggtttataatttgggattttaaatggagtatagaaaagttattgttttttaaataattttgttgagggggaaaatagtgaaagttaaatgttttatttaagagttgttttttttgaaaataatgttttatttaaaagttaaggatagaagatgtagttttgttatgaaggtttatttttttattaaataattattattttgtttttaagttgtaaagggaagatttgttaatttgattgaattttttttttagttttttttaatagttgtgtttagataatttatgatttttgtgttttttgagttttggataattttatatatatgtttggtttggggttttatatttttagaaaaatatagaaattttggaggaggtttagggtagattaagggaaatgattaatgggttgaaagttggagtttatgaagaaaggttgtgagatttgattttttgttatgagaaaagtttgagtggtgatttaataatataaggaggttagtaagtagttgttttttatttttattaaggttgaatgaaatgaaataagatataaattgtaataggaataaaaatgtattataagtgaggatttttaagtattagtattgttggattttagatagttttttaaaagaaggatgtgtagtttatttttttggtttgtaatgataggtttataaatagtgagaaagatgagataattttttaagattttttttggatttattttttataggtttatttattatatttagaaaaattatttgttttaaataaaaattatttgatttttttttttttattttatttatttttttttttttgtttattttttgtaaaatattgttaattgaaataattggggattgattaattgtggtgggtttttttttgtttttaagtgttattttagttttgggagtaagttttttgtttattattattattttttggttattaggggtatgtttattattatttttttatatattaaatttatggtaagggaaaataaaataaaataaaattttttagatttaataaatttgtaagtgttattatggattaaaatataatttttatgttttagaatatgagtatgtaaagggttaaaatgtattttatgtatttgtttgtattagtttatagaatagttttttgatagatagtagatatttagtaattttttattaattgaatgattgtaattatgaagtgaaaggtaattaaagttgagaaagttaggagttttggatgtttttaaatgattttgtatgttagattaatttaaagtttaatttattttttataattatgtattattaaggattttatttttattatgtttgtgttatttggaggtagaaagagggttagttgtatattttgtttaagtttttggttaaaaagattattaaagagtgttttgtagatttatgtattagaattatatgaaagtaggttaaatttttagtgtgtgtttttaaaataagattttaggaagtttatttatttttttttaaattatttttgtatattttttttttttattttttttatgaagaatttaaaatttggttgtagaaaattttttattttaaatattatatagtttaaataggtgagttttaaaaataagttaatgtttattttttatttgatttaatgttttgaaattttttggtttaaatttgttaattttttttatggttttttttttagtaaaattaattaatattatagttatttattattgttagttttaatttatgtttataattttatattttttttgattatgtttatagaattattataataagtaaattaaatttattttttattattaatttttaaatgtttttagtataaatttggtaatttggagggttataagttgatattttttatatgtttgggggtttagttttaatagttttttaatggtttttatgttgttttttttgatttaattaaatattatttttagatgggattagtttttgatttttttgttttatttttttagttttggtttttttaaaagttttttgttgtggttttttttttttgtttgttattaatggttatgtttggttatataatttttgtaataggtgttgattaatttgaatatattttggtatggtattgagttatttttatggtttataaaaagtttagtgagaatgtaatattttatgaatagggaaattattttttttttaaggttttttttaggataggttttatataagaattttaaggattgtgagtgatatagtttaatattggattaggttttttaaattatttaggatgagtttgaaaatatttgtgttattttgtttaatagtagagttttttgtttattaagtattttttttatgttaattatggaaagttttaatagtttttttaggttaatttatttgatgttagattagataatttatttttttttttttgtaaggaatattgaaggtaggagtaattaggaagtttaaataaatataaatataaaatgtttatagtgatagaattgattttagttaattaaaattattaatagaaaaaatatgttaatgttaagtttattatttttgtttttatttgagtaatgaggattagtttatattttttgataagaatagatgggaatttaaatttttttttgatttttgttttttttggaatattgggttaggattatattagaatataattaaaaagaaataaagatttagatgaatttataattaatttttaagttttataaaagtgaaataggtagtattatttttttaagttgtgaaatttttttttattttagtaatagagaaaatgtttagattataaatttggaaattttgtttttaatatattaattatgttagaggttaatttttaagaagaagagaaatgtatgttttatatttttagtattatttttgtttataatagggaaataattttgtaaaatgtttgattttagatttttaaaattatttttatatgttatttgaattaagtaaataaaaaataatatttagaattttatgtaaggtattggtataattttgtttattttggttttattgtttttgaatgtaagatgtatttttaaggtaaataagtatatgttttaagttggttgtatatagtattggtaatgttataattataaattagaaagtttggaaatgtttataagtgttaagaggtgtgatttattatggttatttgaattggtatttgatttttttttttttttaaatatttttgatatttttgatttttttgttttttttttagtaaaattgtattatatattggaaagtgaagatatatatatttatttatataatgttaagggagagtaggaataagaagattggttatagatttatttaattagagtttgggaaatgagaatatttttttttttagtagaaatgttgatgtgttaatgtgaatttagtagaaaaaagatttgttataatttttaagtgagtagtttttagaatgttagtttagatttttggtattaatttgttaggtatttttttaggaaggaaataaattataattgagtttaaaaatttgagggtagaatttatttttaagtaaatgtgaagtattagtttgaagttaataaagttaaagtttggagtagggtttttttagttttttataatgtagtataagtattttttttaaatgtataatattagttttttaaattgtattgtgttattaaaagaaattgtgtttgtatttattttataatttgggaattaatgtagagggtttgtggggtagtggtatttagttttatgttttttgttttttattgttttttggttagtttgtgtattttatatatattaaatattttataataaattttgttatttgtgttgtagggtagtttgtattggttatgtgttttgttaagttgatagaggtgtaaagttaaatgtgtgatatttgaagaatatgtatatatttgaataatttgattatttagtttaataatttgtaaaggtgttttgaatgattatatattttgataatatttttaaggaatagatagttttatttagggggtgggggagatggaagtagggttatttttagtaggaatttttgagtttattgaagttttgtttttggtattttattgtgtgaatgtgggtaaattattttttggtagaggattggattttttttttataaaatgggtaaataatttttgttattagtttttagaagttttaaaatagttaatgttagtgaatttattttgttaattgtaaatttttaggtaaattgaattgagtatgtaataatattatatatttagtttaatagtatatttttggtaattataagagggtttaggaaaggaaattgtttataaatttttttttttagtaaaattaatgttggagtttttagggaaatttttatagtaatagtttttgtaattattaggttaaatttttttgagattatagaaaaatgtatatatatagaaagttgtttgtagaatttgggtgtgggtttggtgggagatttttttgatatttagtgttgtatttttaagagagtgttttttaaagtgtgattttagattgtttgtatttgaattgtttgtggtatttattaaaattataatttttgggttttgttttatttttattaaattataattttaggaggagggatttttattttaatatttatttaggtgatttttatgttttgaggaggtttagggattttaagttaagtatggtattgttgttttattttttattttaaattttaaggtttgtataaattggttgaattaatgagaagaaaatttagttttaaagtagaaatataggtagatggttgatagagtttattaaatggataattgaaaatgttttttggattttagttatataagttttttttaagggttttggttataggtaaatgagaatttgaaaggttatttgtttttttgttgtgggtagtggtgggggtggagggtgggggaggattaattgagttagttttgtttttatttttgaattatttatttttattttggttaaagtagaagattttttatttattttggttgttttggtttgttattaaaagggttagtttatatgtgtgtttgttggggttggaagtgaaaatatttgtaaaagtatgtaatgttttggaatggaatttttttaataaaagatgtattattttaaatgtgttgaattttgattttggtaatttgtgtattagagtgtttattttgaggtagtggaggtattatatgatagtgtatgttaaggtattgtggagtttttttgtggatttttatttatttttttatttattgtggagagggttgtttttgttgttgttttttttggtgaattagtatgaaatttttttgtttttgttgagattaaatggagttttttgttgatggggtgtgagtattatttttgttatgtaatttttattattaataatttaatttttttgttgtagaatagaaggagtatatattgggtattaaagatttgtgtttttttttttttttaattaagtgaagggaatgtgaaaaaataatagagtgtgggagttttggggttgaagttttttttggagtagttgttttgatggttattttgataagtagtgattgaaaaggtgggtttgttttttttttttttttttttgtttttttgtttggttggttagaaagtgtgtggttttagtgaggtttgttattgtttgggttttttggttggaataagtaatttggtgtaatgttatttgggggtgtttattaataaaaaatgttgttattattttgattgaatttttattaggtaaattttagagaggttagtgtgtgaattttgtttaagttggtgtgtttaaggtagtagagtaaattaatagtttttatgttttgtgtgattttattgtgtgtttgtgtttgtaagttttgtagtgtaggaaggtgtgggaaggtgtgtttgtggtttgggaaatgtatgtttttttttagagaatttgggtgttgggatggggaggaaggggagagttgaaagttaggggagtgagattttggggtgtgtgatttttatttgtttttttttgttttagtgtttatagttggggtttttgtagagggtgtgggatgtggggttttttggggttgaggttggggttggaatattttttgaagttgtgggtgttttgtttaaggtgttttaggagggtgtaggatttgtagggtgatgttgtggggttttaggggaggaggtgaggataggttttgggggagtggggagttttgggtgttttttggttttttgtgtgaggaaaagatgtggtgttttttttaagtggttgttttgaatgggtattggtagtgtgggtgagtggggagtggggggtggggggtgggggggggggggtggtgttgtttgattaattgaagtttaattgaagagttaaataatgtttgatttgggtgtaaggtgtagtttggagttttgggtttttgatgttgttgttgttgtgtttgggtgtatttgtttgtttgttgttttgtgtattttgtagtgttttgggtttttgggttggatagaggagttagtttggtgtgtttttttattttttgtttggggggttttaatgagatatttattgttgttgtggggttggtggggagtagtattgtgatggggattggggttgggtgttggagttagaattggaattatgatgtgattttgttgttggggatttgtgaggtttgtgtggattttgaggtaggtaagtgttgggaatggggtttggtgtaggagttgtttgtttgtgggagagagttgattgggggattttttattttaaagttgtgggatgaggttagtttttttttttttttttttttggtagaagggatgatttggagttatttttggggagtttttttttttattttataatttagaaggttagttggtattattagggaaaaagggatttggggaagttatgaagtagaggagggaaggtttggaggagatttagagttgtgtgatgggagtaaagatggtgatttggggattttttgtagtttttttttagtttaggagtagttgagagagatttagggggttagagttgttgagggttttgattgaggggagggtgttggggttaggttaggaatttttttagggggtgggtggtttttgtgttgatttgtggggggagtgggagggaagtttgtgtttttagtttgtattttttttttggagttgtatatggttatttgttttttaggaattgagattgaagtggatttataagtttgaagttaatgtagtttggaaaatttgggaggtggaatttttattgttgggaattgaaagggtttgtgatatttttgggtaggttgaatttatatttttatttattttgtgttttttttttgaagtgttttttagggaagttaagagttttgatttttggggagtggttgggatgtatgtgggggatttttgatttgggttagtttttggggatgtagagttgggaagaggaatgggtgagtgagttatttttggaaagaaatagttgaggattgggggttttgtgtttgatgggtaagaagaaggggagattatagattaggggtatttttaaggaagaagttttggggttgtgagggtgaattggaggatgtagtgtttgtgtgttgggggtagagtggggatgagggattggggtggaggggaggtgaggaggaggaggggatttagagaatgaagttagggaaggtagagggtgttttttgttggttatgttgttaagagtagttattgggggtgggaggttgggggtggggaagtggtaaaggaaggttttgtgggattttttagagagttggtaggagggatttgttgaatggtgttgttgattttagtttggtggggtgtgtgatttgttgttggtggattttgattttttgtttttgtttggtttttatgtaagttttttttgtgttgggggagttttgataagttttgattggtggtgtgttagggttttttggattttattttagggttttttagttattttgtatttattttttaatgttagtagtaattaaagaatattttttgataagtatgtaggaatgtttttggttagaagtaaagaaaggtatatttttgagtgtttattaatttttttagtaattttttaaagtaaagtaatatgtaattgggaatgttgattttttaattgtatataaaaggtgatatgatattaaatgagatttttttttattgatttaatattttgtaaaattttttttttttttttattattatggaaaaatttatttttatatgagtttgttgtaaggttaaaagttattttggttttataatttgatatgtttttatattttaatttattgaggtataattatagatttaatttgtatgaatgtgtgtgtttttaatgtttattttatgtaatataatttttaggttggagatttttgatgttatggtatgtagtgttttaaggtattatatataataggtaatatagtatgttgaaattatattataaagttttgattttgggaatagtattttttaaaaataattattaaatttttgtttttgttttttgattttgtaaatgttttgtttaagatttttttttttttttttttttttttttttttgggaaatttatttttgggttagtaggagaggtaaaaaaaaggaaagagatatttgttgaaatgtaattataatttttattggaatttaaaatatgttggttattattattggaattttagggttataaagttgttgtttttttttttttttattttattttgtaaaatgtgataaatgttggtaaatatagattagtagtaagtattatgatattaaaagtattatgtatgtggaattattttaagttattatagaatattttttatttataaatgatataagtagaaagaaatgatttttagataaataaggtttatgtatatgttttgaagtattagaatattgtagatatttttagatattatattttttaaagtaaaataatagtaattttttatatatttttggagttttttatagtttatttagagttgagttagtagttggaagttttttttattttaaggtgatattttaaaattatttaatatgtatagtaggttaatattggtgtatttagaaaatgaagtatttaggaaatttgttttagtgtttttttaatgtgtgtaatttttatttgtaaattaatggaattaagaaagttattatttgtttaaaatgtagttattattttaaatgatttatttatattatgtgagttaattgtttttattttattaatggttaaggagggaagggaggttttggggtattttttgtttattttgatttattaggagggaaaattttgtaaaaaaagaaatgtaaatttttaaaattttggtttaaagtttgtgggttttttgtttaaaaggggtgttatgaaaatgtaagttatttttttttttttggaatttttaagagttttagttttttaatagttaaaatgtagatgattgatattattttttatatgaatagtattggtttgtagtttagtatgtatagtgagttgggtatgtttatttgatagtatagtagagaatttgtttatattttttttatatttattttttaaaatttggggtgttttttttttttttttttttttttttttttttgtgtgtgtgtgtgtgtgtgtgtgtgtatgtgtgtgtgtgtgtagagggggagagagagagagagagaattgtgaattgtgaaatataatatagttagtagttttgggttttaattgtagatttatttttaaggaaatttatagaatggaaaggttatgtttaagtagtttattaatattttgagatgtaggaaattaattttggagtatagaagaataattttagattttttgaataaaaatagatagtatagagagtggatgatagttaaattttgaatattttttgagaagaaaggtatttttattttaggtgtttataatatggatttgattttagtgattaaaatattaatttttaatttgtatttttttgtgtggaagagtttaatttgtgtgaggggttttgtttatttaataaaagtgaatatgttttttttatagggtaattgttaatttgttttaatttgtttttaaataattgttatagagtatttagtttttattaattgtaaaattgttgtttaattgaaggatttttagttatttagtgtagttatttagttattggtaggttttgtgattttaaattgtgaattgtattttaaagaggaattgaggagagaattttgtggaattttaggttttaagtgttggttgttgtttaatggaagaggaaattatttgaataagaattgtattaagttgtgttgtgataaattttttttattaggatgaataatatgtatagatgagttttaaaagtgaatgagtaaatttattggttatattttgtatttatttattttgtttagtatggagtaatgttaggtaataaatgatgttggtaaatgaaatttgtatgttatttgtatgtggtatttaaatttaggaaatatagagtggttttggtatttgtaggtttagttatgtgtgttttaaatgtttttttaaatttttatttaaggtatagaattatttaattttaaataattttatatttaagtgttttattggatttttagaatatttatattgtaaagatttagaaaggttatgaatttaattattgattatatggaattattattgatggtagatgtaaaatggagtttattaatgtattgatattgaaaattttttgtaggggagaggagggggagtggtaaatgtgtgtgttttttaagtggaataggaaggtatttttttttttgtagaaaaatttgagtatttggttagataagtgtggaagtttttatttaaattaagtatttaagtttaagtagaagttttagggtatttatttttttgatgagataaattttattaaatatattagatgttaagaagtggtttattgttttgatgttttatttatagattgatgtttgaggatgggttgtattaagtgagttagggggttgagtgtgggataggagaatgattggaaggaagtaaagtaaatttataagttttagtgatagttataataaagtaaaagtttatttttagagagtttagagagtaaggaatgttatatagttttttttaaaggtttatttgaaagaattttttattggttgttatggtagtaatgttttgattttgaaattttttagaatttagtagtttttaaatatgtttttattttggtttttttggtttgatggaaattttatgatgattttttgtgtttttgatatgtttttgtatttttggagagaggaggttaggtaagggaggattttttaaaattaagatagtatagtaaggaaatataaaattatatgataaaaaattattgaattttaaattgatttattgaaataaaatttagaaggtaatttgttgtttaattataattagtttgtataaaattaaaatttataaaatgggaatttaaagaaaataaatgggtagttttaagtaatttaagtaatttattaaaaattgaagtaatagtgttatttagagaataaaattattagttttattagttaaatggtttatttttatatgaattatttttttaatgttatagttattaggatttttttgttattatatttagattttgtgagtgtgtatgggggtgggggttgtatgtggaattatagatgaaattttaaaataagtagatttataatttgatatatgtattaaatttttttaatgttgtaatgtagttaaatgtagaatagtatgttaggaattaatggttagtattttttttaatatttattatttttatggatatgtattaaattgaattattgagtataaaggttttgattttatttatttgttataggtaatttattatattttttgagatataataatattaaataatttgagtagagagatttttaagaatgtttttgatttatgatttatttttaattttaatgtatttagaagatgtgagaataaaataaagttaaatataagtaagattttaaatatatatataaaaaataaataaataagaaaaaggaagaaaattataaggattgttttaattttagaatagatgaaggtatatatttgagttagtattaaaaaaaaaaaaaaaaaaagttatggaattaggaattaataattataaattgatttaaaatttttggatgataaaaatttatatttagtttatttttgtatgtgtttataatagtatttaaaatagttttggggaggtattttgataaatgttgttgaatgtattaatagattgattaatggttgttttagattattattagtgatgtagatagaaattttatgaaaatggtttgttttgttggaagaaaggtagaaattggaggaaaaggtttaataatatttttttttagtatttattataaaagttatttagttggtttagttttataattttttatgtgtaatttgatttatttatgaaattgtgaatatatgaaatgttaaagttgatttagatagtaattataagtttgtggatttttttttaaatgtttttaaatttttaaatgttagtggagatgttagtgattgtgttttagggagtagaatatagtatattttaaatttgtgttaatttttggtaagtagagaaaaaattgtatgataattaaagaaagttatattgtttgtgttttgtgttatttatggaagtaattaggtgtagaaaatttttttttttagaaaaaaaaaattattaaaataaaggtgtgtgtgtgtgtatgtatatatatttaaagggagagagggagaaggaaatttattaaataaaatttttgttatatgggatttagtttaattagttttggttttggagttgttattattagtagttttattttgtgattttttttttttgtttttatgtgtttttgaaaattgaaattatgtttaaattaaaataagtttttttgtttttttatatgtttatttattttttgaatgtgtttttaaatatagataaattttttttatattatgtagaatttgaaggttgagaaatttgtagttattttgttggagagagatgtttggtggagttttaggttatatttttaggttaaatttttgaaggtattttttttatgtaatattgggaaaatatatttagtattgatatgttggttgataatgtgtttgaaggtatagatgatatgtttattatatgaaatataaagttagtagatattgtagatattttgttgaatgatagaatttggattatttatatttatttaaatgtaaaatattatgattaagtataaaaaaattaatttaggagagaatagagagttgtgggtatggttttaggggatgatttattagtagattgtagaaaggaagtttgaatgttttaaattaattgtaagtttagtataagttagtggtgtgataagaggttgttattatagttattgaaattttgggttgtattgttagaaatataatattgaaatggagaagttaataattttttattttttaaatagattgtatttagaatattattattagtttaaggaaatgaaataagttgttttaggtatattattgataaattagtgtatatttaaattattgtgattaggatgtatagggaatttgaaagtattgtatgtgagtaatggttgaggggatttggaatgtatgatttagggataagaaaatttaggttggaatggtaagtggtttttgaatgttgggttgagaagaattttaaaattgtgaaggattagtaaaaataatatttagattgttaatgtttattgtggttgggagattagagtgttaatatgtgtgatgtatttttgatatttttattttgaggatgggttttaaagatttgatgaattgttataagtgtaatttgtgttgttttagatagtagttttagaattaatgatgtaaatttagatattttatatggtagttagaaaattttttattaatttaatttagtaaatattgaatgtttattgtatatagagtattttattagaggaatatataataaagaaaaaagaggtttggtgtggtggtttatgtttgtaattttagtattttgggaggttgaggtgggaggattatttgagtttaggagattattatgagtttggataatatagtaagattttatttttataaaagataaaaaaaattatttaagtttggtgataggtatttgtagttttagttatttgggaggttgaggtagtaggattgtttgagtttaggaggttggggttgtagtgagttgtgattgttttattgttttttagtttgggtgatagagtgagattttgttggagggaaggaagggaaggaaggaagaaaggtaggaaggttgaaatgaaatttttttagaaatgatattaaaatgggaggttggagtaaggtattttttgaagtgtttttgtatttgtttttttttaatgtattggttataagtttgttttttatttatagtttataaataattttaatgagaatagttatatatttttgtttttgaattatttatttgaagtgtttagtattatgaattgagtattagaaattttttttatttttttgtaaagtgttgtattttatttttttttatttgtatatagatttttaaaattggttattttttttttgggttagatagaatagaatgtttggaaaaaaaagtttttattaaatttaggtgtttaaattgtttaagaaattaatttttgaggttatatttttttagggtttagtagttaaattaagaaaattttttattgtttatttttatttttggaaattataaaatttttagatattatagttttttaaagagtttttttttttaaatataaattaaaaggaattgattttttttttaatttttttaggttttagtatggatagagttattttttttttttaataatttatttataatttattttgtttttttgtagaatagttggagattaagtaatatggttatgatataaaatgtaagttagattataagatgagtagtttattttaagtatgaatgagtatttattttttgtgattttttatattgtttttaggtattaatagtgttagttagtaaagtaaatagtttaatatttatattttttttaggatattatatagtttatagtttgtatgtgtttttgtgtgtatgtttttttttgttttaaattttttttttttaaagtaagaatgttatatgtagtaaatggtttttttattaatttatttgttaatttattgtgtattaattgagtgtttagtgagtgttaggtattgggttatttggattttttttttttgtattgatttatatatttttaggtgttttttgatatggttttttattgatttttttatataaggtttttattatttatttatatatttttttttaaagaggattggtttaaaagtaaaattttgagtaagttttttgagttattttagaattttttgtttttaaattgtatttttaattattgattggtagtattttggaataatttattttttttttttaaagattgaagttttttattttttttgatttttaggtgttagtttgtgtataaattgagataataaaaatgtttgttagatatttttttaaagtattttgttatgtgagaattttttatgaagaattttttttaataatgattttatagtagaagttatagtagagggagaattattgaattaaagatggtgtttgagtttatgattttatgatggattttttttttttttatatataaggatatgtatgggttttttagtatttaggaatttgttttttatttgatagtatttataaattgtgtgtttttttttaaaaaaatttaaattgtgagaatgtttttatttattagaagttggttaatgattatgttaaataaggaaaataagatagaaaaattagtttagtgaatattattttgtttttaaatttagtaatttagtaatagtatttttttggggtttattagaaattattttttaatttaataggttttttttattgtgaagttaggaggtgattttgtttaaatgtgtagtataggaatttatatgtggtgtttaaggattatgtaaatatgttgatataattggagtatagtttggtattattaatttagaaatatttaaatttttgttatataatatggaagtaaatttgtgtatagtttgtgtgtgtgtgtgtgtgtgaattttaaaaaaagaaaaaaattataggattaggaagttggaataggttttattttttttttagtattaaatttatagttatgtttttagtttttttttttatttttaagtaagatagataggtaaatgattattttgttgtttatttttgtgtatatttatttgtattgagagttgtatttatttgtttgttgagagtatttataaatggtatttgataaagtagatatttttttaaatatgtgaatttttttgtattgtataatgtttagaaataattatgtataaatggttgaatattaatataggattgttttattaagtattttattaattattaaaatgtggtgttattaatataatttattttaagtgttttttttaaaatattagattatttttttgatttttatatttttgataatgatttttttaaatttggtagttaggaatagaaaatttaatattgtatgtttttatttataagtgggagttgaatagagagaatatatggatttagggaggggaattatatatattggggtttggagtagggggtaggggaagggagagagtgtgttaggataaatagataaatagttaatgtatgtgagttttaatatttaggtgatgggttgataggtgtagtaaattattatgatatatatttatttatgtaataaatttgtatattttgtatatgtattttggaatttaaagtaaaataaaaaataataataaaataaaataaatttagtagtatttattgttttagagtttgtaattgttttttaggtagttttatataaaaatttaggagaatttttattgttattgttttatgaggtgttaggaaaatttgttttattgtagtgttttagtaggtattggtattgagattaaaatttagttggtttgttgttattatgatttttatgtgattttatttgttatgtagataagattgtatattttaataataattttgtttaaatgtgtggtattttatatatttttaaaatgtatttatatattttattttatttgattttataaataattttataaaaaagattggtagatattatttttatataatagaggaggaaattggagtttagagaagttaaatagtaatttaaaatgtatagttgtagaattagagtaaggatgatagtttagtgattttatttaatttagtttttttattattattttagttgtttataattaaaatttgtagtatttaagtaagaaattatattttgtttttgatgtattaatgtgagatttggagtaggaataggttgatattgttattttggtttattgtttatttttgtttttagtagagattggtatttttttgtgtgttaaggaataaagtggtaatgggaagattaaaaatgttttttttaaggagttttttaatttaatttttttaaaaaagaaaaaatttttagagggaaaaatgaatatatgatttttgatgtattgttttttagtaatttagttataattttatttaaatttgagatttttgttaagtgaatgattagaaatattaggtggttggttagatggtaaataggaatagttgtagtttgtagtttttagagagattaatgtagaaggtgggtgatttttgtatttttaattgaggtattgggtttattttattgggattggttagatagtgggtgtagtttatggagggtgagttaaagtagggtggagtattgttttatttaggaagtgtaaggggttaggggaatttttttttttagttaagggaagttttgagggattgtgttatgagggatagtgttatttggtttagatattatatattttttatagtttttgtagttggtagattaggagatttttttgggtgtttatattattagggttttgggttttaagtataaaattgggtggttatttgggtagatatttagttagttgtaggagtttttttttatattttagtggtatttgaaattttagtgagatagaattatttatttttttggaaaggggttgaaggttaggtagttaagtgatttagtttagtagattttatttttatggagtatggtaaggtaagatttgttggtttgaaatttttattgttagtatagttgtttgaagttaatttgggatgttttagtttggttgggggaggggtatttgttattattgaggtttgagtaggttgttttttttttataatgtaaataaagttattgggaagtttgaattgggtggagtttattatagtttagtaaagtttttgtagttagattgtttttttagattttttttttttgggtagggtatttgggaaagaaaggtagtagttttagttaggggtttatagataaaatttttattttatgggatagagtatttgggagagggggtggttgtgggtttagttttagtagatttaaatgttttttgtttgttggttgtgaagagagtagtggattttttagtatagtatttgagttttgttaagggatagattgtttttttaagtaggtttttgatttttgtgatttttgagtgggagatattttttagtaggggttgatagatattttatataggagagttttggttggtatttggtgggtgtttttttgggataaattttttagaggaaggaataggtagtagtttttgttgttttgtagtttttgttggtgatatttaggtaaatagggtttggagtggatttttattaaattttagtagatttgtagtagaggggtttgattgttagaaggaaaattaataaataggaatagtattaatattaataaaaaggatgtttatatgaaaattttgtataaaggttgttaatattaaagattaaatatagataaatttataaggatgaggaaaatttagtataaaaaggttgaaaattttaaaaattagaatgtttttttttttttaagggagtataattttttgttagtaagggaataaaattggatggagaatgagtttgatgaattgatagaagtatgttttagaaagtgggtaaaaatagatttttttaagttaaaggagtatgttttaatttaatgtaaagaagttaagaattttgaaaaaaggttggaggaattgttaattagaataattagtttagagaagaatataaatgatttaatggagttgaaaaatatagtatgagaattttgtgaagtatatataagttttaataattgaattgataaagtagaggaaaggatattagagattgaagattaatttaatgaaataaagtatgaagataagattagagaaaaaaagaatgaaaaggaaggaataaagtttttaagaaatgtgggattatgtgaaaagattaaatttatattttattggtgtatttgaaagtggtggggataatggaattaagttggaaaatattttttaggatattatttaggagaatttttttaaattagtaagataagttaatatttaaatttaggaaatatagagaatattataaagatattttttaagaagagtaaatttaagatatgtaattgttagatttattaaggttgaaatgtaggaaaaaaagttaagggtagtgagagagaaaggttgggttatttaaaaagggaagtttattagattaatagtggattttttagtagaaattttataagtttataagttagaagagagtgggggttaatatttaatatttttaaagaaaagaatttttaatttagaattttatatttagttaattaagttttagaagtgaagtagaaataaaattttttatagatgagtaaatgttgagagattttgttattattaggtatgttttataagagtttttgaaggaagtattaaataaggaaaggaaaaattggtattagttattgtagaaatatattaaattgtaaagattattgaaattatgaagaaattgtattaattaatgggtaaaataattagttaatattataatgataggattaaatttatatataataatattaattttaaatataaatgggttaaatgttttaattaaaagattatagattggtaaattggataaagagttaagatttattagtgtgttgtgttttggagatttattttatatgtaaagatatatataggttgaaaataaagggatggaggaagatttattaagtaaatggaaagtaaaaaaaaagtaggggttgtaattttagtttttgataaaatagattttaaattaataaagattaaaagagataaagaaggttattatataatgataaagggattaatttaataagaagagttaattattttaaatatatatgtatttaatataggagtatttagatttataaagtaagtttttagagatttataaagagattaagatttttatataataatagtgtgagattttaatattttaatgttaatattaggttaatgagatagaaaattaataagtatatttaggatttgaatttagttttggatttagtggaattaatagatatttatagaattttttattttatattaatagaatatatattttttttagtattatattatatttattttaaaattgattatataattggaagtaaaatattttttagtaaatgtaaaagaatggaaattataataaatagttttttagattaaagtgtaattaaattagaatttaggattaagaaattaatttaaaattatataattatagtggaaattgaataatttgtttttgaatgattattgagtaaataataaaaagaaggtagaaataaatatattatttgagattaatgagaataaagatataatatattagaatttttgggatatagttaaaatagtgtttaggggaaatttatagtaataaatgtttataggagaaagtaggaaagagttaaaattaatattttaatattataattaaaggaattagagaagtaagagtaaatatatttaaaagttagtagaagataagaaataattaagattagagtagaattgaaggagattagagatataaaaaattttttaaaaaaattagtgaatttagaagttggttttttgaaaagattaataaaatagatagaatgttagttagattgataaagaagaaaagagagaagaattaaatagatgtaataaaagatgataaagaggatattattattgattttataaaaatataatttattattagagaatattataaatatttttatgtaaataaattagaaaatttagaagaaatgaataaatttttggatatatatatttttttaagattaaaggaagaagttaaatttttgaatagattaataataagttttgaaattgaggtagtaattaatagtttattaattaaaaaaagtttaggattagatggatttatagttgaattttattagaagtataaagaagagttggtattattttttttgaaattattttaattaatagaaaaggagggaattttttttaatttattttatgagtttggtattattttgatataaaaatttggtagagatatagtaaaaaaataaaattgtaggttaatatttttgatgaatattgatgtaaaaatttttaataaaaaattggtaaattgaatttagtagtatattaaaaagtttatttattatgataatttggttttatttttgggatgtaaggttggtttaatatatgtaaattaataaagataatttattatataaagagaattaatgataaaaattatatgattattttaatagatgtagaaaaggttttttataaaatttaatagttttttatgttaaaaatttttaataaattaggtattgatggaatatattttaaaataataagagttatttatgagaaatttatagttaatattatattgaatgggtaaaagttggaagtatttatttgaaaattggtataaaataaggatgttttttgttattatttttatttaatatagtattggatgttttagttagggtaattaggtaatagaaagaaataaagtatatttaaataggaagagaggaagttaaattgtttttgtttgtagatgatatgattgtatatttagaaaattttattattttagtttaaaatttttttaagttgataagtaattttagtaaagttttaggatataaaattaatgtgtaaaaattatgagtatttttatatattaataatgataaatagttaagttatgagtgaatttttatttataattgttataaagagaataaaatgtttaggaatataatttataagggatgtgaaggatttttttaaagagaattataaattattgtttaatgaaataagagaggatataaataaatggaagaatattttatttttatggataggaagaattaatattgtgaaaatggttatattgtttaaagtaatttatagatttaatgttatttttattaagttattattgattttttttatagaattagaaaaaattattttaaattttatatggaattaaaaaatagtttgtatagttaagataattttaagtaaaatgaataagttggaggtattatgttatttgattttaaattatattataaggttatagtaattaaaatattatggtattggtatataaatagatagatagattaatggaatagaatagaggttttagaaataatgttatatatttataattatttgatttttgataaatatgataaaaataagtaatgtagaaaggattttttatttaataaatggtgttgggaaaattggttagttatttgtagaaaattgaaattggattttttttttatatgttatataaaaattaatttaagatggattaaagatttaaatataaaatataaaattataaaaattttagaagaaaatttaggtaatattatttaggatataggtatggtaaagattttatgattaaaatattaaaagtaatggtaataaaagttaaaattgataaatgggatttaattaaattaaagagtttttgtatagtaaaagaaattaatattagagtgaataggtaattgatagaatgggtgaaattttttgtaatgtatttatttgataaaaggttaatatttagaatttataaggaatttaaataagtttataagaaaaaaaataattttattaaaaagtgggtgaagggtatgaatagatgttttttaaaagaagaaatttatgttgttaataaatatatgaagaaaagtttattattattggttattagagaaatgtaaattaaaattatagtgagatattattttatgttagttagaatggtgattattaaaaagttaggaaataatagatgtaggagaggatgtagagaaataggaatatttttatattgttggtgggagtgtaaattagtttaattattgtggaagatagtgtggtgattttttaaggatttagaattagaaatattttttgatttagttattttattattgggtatatatttaaaggattataaattatgttattataaagatatatgtatatgtatgtttattgtggtattatttataatagtaaagatttggaattaatttgaatgtttattaatgatagattggataaagaaaatgtgatatatatatattatggaatattatgtagttataaaaaaggatgagtttatgttttttgtagggatatggatgaagttggaaattattatttttggtaaggtaatataggaatagaaaattaaatattatatgtttttatttataagtgggagttgaatagtgagaatatatggatattgggaggagaatattatatattggggtttgttagggtgtaggaggttaggggagggatagtattaggagaaatatttaatgtagatgataagttgatgagtgtagtaaattattatggtatttgtatatttaggtaataaatttgtatgttttgtatatgtattttagaatttaaaagtattattattattattataataataataataaaagaaatataataaaatagaatgtagtatatagtagtgatttttaaatatatttagtattagaattatttttgaatttttaaaatatatatatatatgagattttagtttttaagatttgtaagtttggtattgggtttttgggtttatgttgggtttagaaatttttatagatggtttggatgtatgggatagtttaagaattgttgaattaaaattaaataaattgaatattttgtgatttagagagatttattgtttattttattatttaagtatttgtattagagtgtggttagaagggatttgtagttttgtaaataattagaaatttagatattttgagatgagagaattgttgaagattttattttgatttgaaataaattttttaattagaaatttttaggtgagagtaaaggtttggaataatatttttgagttagaggaggattgagtttgattttaggtttaatatttattaggtttatgattttgggttagtaatttaaattttttgtattttaattttttaatagggtattggtagggattaaatgtgttagtgtttgtgaagtgtttagagtagtgtttggtatagtaaatgtttaatgaattttagttattgtttttatttttagtattttttagtttttttaaaaagatattttttttagatttgtattaagataataaaaagtttaattagtatgttttatatttaaatatgttttattttatagtaaagtttataagattaaaattgttttgttgtaattttttgagttttatgtgtttattaatgattttttttgttgtttatttatttgaattttatttattttttaagatttagttggaattttgtttttagaaagatttttgtttataataataaatttgttttatttgagtttttaggtggtttgtattttataatttggtaattaattgtatatgtatttatataataaaatattattgtgtgtttttgttgtattagattttaggttggaagttgtagatatgatgtttttgtttagaaaaatgttttagaatgttttatttaggatagtttgttgattttaaagatatattttttaaatagatattttatgaggtagttttagtttgtatttgtgtttttggatttgatgattaagtttgatttaagttttattatttattagttttgtgattttgggtaagttatttgaattttttgtgtgtagatagaataatgttgagggaaattttttttttttatttttgtgtttttataagggaatttgttttttaataagtaatatttttaggggaatattttaggttttttttttatttttattatttgttttttttgtgaaaagaggagaggttaatttgatggatgaaatttttaattttttattttttggattgtagagtttgtgaattaaagtaatggattatttgtattgaaattgaggttgattttgtattttgatttttatttggtaatttatttttattttgtttttaatttaaaattttaaggggagaaggaagataattgattattagaagtatgtaatggtggtaggaagttgaataaatggtaattttttaaaagttgtatgagatatagtttttattttagagaagttaagtttgtttttttttttttttatgtattttagtattatttttataattagattgtaaattttttaaaagtaagaatatttttatatttttttatttttgatagtatatagtagattgttgggtatatatatagtaggtggttttgtaggtatttgttaaatgatttaatatgttttttttttatggaaaagaaagattttagtattgtttttattagttaggaaggtattttgaataggaaattagttttaggtaggtatttataaatgggttatgatttttaatttatttgttttagaggtttgttaatgttgaattttttatgggtattttgttttgttttatgagttatatatgttaaggggttagtagattatataattttttgatttataaaatatgatttttattgaataaaaatttgggttaaaggttttttttttttgttatttttttttttttttttatttttttttttgggaatgttttttgtgtatgttagttatagtatgtattatattgtattgtattgttggtttttgggtttaatttatttttaatattgtagtttttaagggtagaaatttagttttatttattttgatgtttttagtgtttgtgtttagagaatatttattatttgaaaaaatagtgtaaaagtaaattttaggagattatattatatttatttaaattgtaagtttgataagttgatatttaaaagaaaggtttttttaaataattttgttatagaaatttgggtgatttttgtagttttggagaaagtagaggtaaaaatgaaatttaaaaattatttgtgggtttttaaaaaatgtttttttatggagtaaaggtttatagttgagttttttttatatgagggaatgatagaaatatagttggttttgatttttagttttaattgagtgattagagttttgttggtgaaataggaatttgtattgtgtttttgatgtgtattttgaaggtgttagtttattgtttttttgtttatataaatagttttttaagaattgtttttgattttgtgagtttttaattaaatgattaattatgtaaagttggttatttggggtaatattgaagtattttttttgagggttattgataggtgggaatgtgtttatttttttgggtttttggtttttatgttatatttgtaaattagtgatagtttaaatttggggtaattatttagtaagtttattgagttattaagttaattatttttattttgtatgaagtaattttgaaaatgatttttttaaagtaaagtatatttaaatttagtatttttttaataatttttgttgaatgaataaatgattaatttataaaaaatgtaatatatttttaatttttatttatgggtagtttaagttttttgtgtaagaggaggttttggtttgagataatataggatagtaagttttttagagaaatttttatatggaaatatggtttgttatgaagttagaagtgagaggatattatatttgattattatatttggttttagagttttttaatatggggtttaaagttaaggttttttgttttattaagaggaggtttaggagtgtatgatatttattagattattgagatttagttggaattaggtattttgtataggggttttgtttaattaaaatagtttttattttttttgagttttaagtaattagttttttaatttagtgtttggatagtagtgttaagtgggagtatttttaatgaatttttttatgaggttatttttagtttattggaatgttttgttttaggagggtgaggaagggaagttttgaatttttgtgtttagtttaatgttgtgatatagttttgattatttgtttaatgggagatttgttttttagatgattatatatgtggaaaggagaagttttttgagtgttttttttaattttttttaaagaatggttttttatttagtttttatatttgggggtaaaaggttttttagggagattttttaaaagtatttgaagtttgtatttgattttagaggtgagttggaggtttatttgtgtatgatagatatatgtttttaataattatatgtttataaggattaagagttatttttttgggtttattatttaatattgattttatatttgtgtttgtattagtatttttatagtgtgtttttagttatatttttttaattttttttagtaggttttatagaatttgtagtgtatgtaatggtagatgattatatgtggagttatttaattatattttttattgtaagttagtttgtttttgatgtttgtttatgtttagattttattttttggaagattttatttttttgtattattttagtattttagatgtttttgagattgggtttttttttttttttatgtttggttatggttatttttttagggttgtgttgtgttttatagttgttgtttgtagggttgatttttataatgtataaagtttttttttatatgttgataatttttggtgtgatgttgtgagttaggtagggtgtgtatatgtgtttttattatattatagtggtaaggtaatagggtttttgaatttgattatttatgaatttgtttaatttgttggtaaaaaatggttatgtattagttgttttatagggttagtttaatagaaagtgggagttaggtaggattagaatttaggattttagtttttggttttagggattattttttatatttaattgttttattttgaattagttttttttagggaaatatttttaaaattgagatggtatttataggattttttaattgtagttattattaggaaaaataagtaaaggaattggtgtaaatttttgtttttggtgattggtggagatttggagattgttttgtgttaaaagtaaagttattagattaaatgttttgttaataaattggttatttttaatttaattatttgatagttaatttatattatttaaaaattaaaataaaatttaaaagaagtttatattgaaaagttttgttttatttatattttgtttattttagtattttttaatatatattatttataaggtgattatttgtattagttttttgtgaatttttgatagtgtgttttatatagatataggtaaatatgagtatgtattattattttttttttattttattttgttttttttttgagatggagttttgttttgttgtttaggttggagtgtagtggtatgattttggtttattgtaagttttattatttttttttatttttaaaataaaaggtagtagttatatatatattattttatattttgttttattatttattaatatatattagagagttttttattattttgtatatatgtatttatatttgttaattatttttagaagtggaattgttgggttagtaggaaaaattatgtataattttgataggtattgtttaattgttttgtatagggtttgaattgtttgtatttttatttttagtgtatgagaagatttgtttttttatagttttattaaatagagtgtgtgagattagatgagaaataggaggtgagtagttttttattttatttgtagtttgtagtgggaatattgtatagttgtaagagttggtgtaggtattagattagttttagtggaaatgttgttttattatggttatgggtttgtgttagttttagtgatatatatggaatggatttatgttgttatttgtagaattttttgtagtagaaagttgaatatgtatttattatttatttaattagttatgttggatttaaagagtataatagtgttttttagaattaaaaagaaaattgttttattataatatattgtgtataaggtttttaatgttttttttttagttattaatattatttttaggattgagtttaagagatgtattttaaattatagggatgttttgttaagtttggaatttttatatttaagggatgtttttttgaggaatgattttatatttatttaatatttgtaattaaataattagtattttataagataaatttaaattgtttaagtataatataaatattgaattatgatgtattattgttagattttttttttaaagttgttaagtggttttttgtattaggtaaataggggattatataaaaatgttatgatttatggtttagataatatttttattatttgagtagtatatattttaggttatttttatataattttttattatttttattagaaaggttgatttttagttttatttttttttgaggatagtaaaaaaaaaaattttttttagttttattgtatagaaaagtgtggtaaatggagttgggtatagtggttatttaatttaaatggataatattttttatagaattttgatagggttattgtataggggaaagttatttttttttttttttatagaagagttgtatttggatagttgtattgatgattgtatttagtttatataagaggttatttttgggtataagaatggattgttaaaatttagttgaaatattattgataaatagatatttttttttgttaataatatttgtgaaggtttttataatagatatttttagttttgtttttaggttttttgtagttgtttttttaaaagtgtgtttttttttaagagttgataatggttagaagtaaggtgttttgttttttgtgttattattatttaatttgttatatatatttgggatgttagtttaggtataggttttgtatttatttagtatggtttgtgggtttggttgtttttgttatttatgttgagggtttttgggtattagtttggtgtgagagaatttattttatgatttttttttttttggttgttttgatttgatggtttttgttggtatagtttgtgagtgtttgatgttttatttatgttggattatttgttttgttgtttttgtggtttgaagttgttttttgaattattttttgataataaatttgagatgattttgttttatttttttttttaagttatattttagttttttagttatatttttgaagaatatgataaatggatgggttataagttatgtagtatagggtgttagattatgaggttttgaagggattttgttgggtgttaaaaagaaagattttgtgttattatgattttttttaaaggtatgttgatatttaggttttaattgaaagtgtttttatttaagtagagttgatagaggagtatttggtagttgtggttgttggtttgaagagtatgtggttttgttttaatgtttaatgagatttttttatgggaaaatgttttgatattttaaataaatgatttttatgtatagttttgataaaatattttattaagtatgtatatatggttggtattttgtggtaataatttaatattggaaatagagtagtaataaagaaatattagggttatatttaatttttgtggaattagtgtgtaaataaattgtttattagaaatgtttatatggggttttgtttaaataaataagaaattggtatatagggtttgtaggatatttttgttaagtagattttttttatattataagatattatatttatgtttgattttatatggaaagaggtatagtaagttagtattggtttatattttttttttattatataatgggtatgtgattttagggaatttattgaaattttttgggttttagtttttttagttataaatggtggataattaaattatttattttattattaataaatgttagttattattttttattaagtttaatataaagagaaatattttatttatttttttagttatttagagtattttttaaaattttattattaataaatattgtattgtatttattatagtaattatgtaaaaatggagtttttgttttatgtttagatgaaatatgttggtatttgagtttgtatgttttttataggaattagtgtttagtgaaaatgggtggagataaatagatgtttttatagttttgttgtttatagtattgttaaattgaatgtttttatataggtgtattttaatggtttaaatgatgtagatattttttggttagttatatggattttttgttatttaagatgttaatattttttttatattttatagtagttttggagtatagttagttttttgaatagggtttatatggtttattatgtatagggtttggaaattgttttatttgtgttgttgaaatgaattgtgatattttagaagagttgggagttggggtagagtagtggttaggagaatatatttaattatatttttttttgtattaagttataagtaatgagtatttttttgtgttttatagttaagtaattaaaagaaattatagagtgggatgtaaaaataatttgaaggataattggatgtgtggagttattagttttttttatgagtgtataaggttaatttttgttattatttagaatgttgagtttttatagaaagggttgtaggtttatatatgttttggtgtttatttatatgtttttgtatggtatgattgtgtattttagaagaagggttgtgttgtgtatttttatgttttagtggaatttaataaattgatttttgaaaatggttttataaaggtgagtaatagagagttaatagtttttttttgttaattttattttttttttaagattttttgataatagtttgaaaaggagtgttattttttggtttttagaggtaatttatttttttagttttttttattatttgtttttattttttttgtttttttaaatttaatgttgtatgtattttagaggataggatttaatttagtgtggtttttttattaggtgagaattatttattttatttttattttagtttttttgaattaatgatattgaagtttggtagtttggttttaagatgggtttaattatgtatagatattttttttataatggaaattgtttagataattaattaattataagaatatattgtttatggaaaattttaggagtattgtttgtggaaaaattgggaagggtatgttgttattatagttttggggtttattaaaagtgtggttatgtagtattggtgtttagtggggtgttggtttttaattgttagaatttttatagtattttatggtagaaagttaaggtgtttagtaatattttgaaagtgatttgttgattaaagttgttaattttgaagaaagagattgaaataagataaatgggttttaatttttttttttttttttttttttgtaaaaatgtgtgattgttttggtatgtttttaatttttatataatgttaatatttttttttaaagggggattttttttatttttggatttgagaattattgtatgttttttttttagggataatgaatgtagttgtattatttttgtttttttttttttttttgtatatagtatgtttatttttggatgtagggatttgaaagataaagttttatttggtttttataatattttttattagtaggtgtgttttgtgtgtaatttgaaggaggtggttttttagttgtgtttatattgtatttttaaatgtggggttgaaggtagaattaattatatttaagatgttatttgggaaaatagggttttgtgttattttagttttatttatttgtaaatgatttaatagtagtattattagggtttttagtgtgagttatttgtatttggattggtgaatttggtgattttttggtgtttggaaataaataatttttgtagttttttgtaaaaagtttgaatagtggattagtttttagttttatttgtaaagttgtttttattaaattttttataatgtttaatttaaaaaatgttatatttttttttggaaatttaattttttttttttttttaaaagttattttaagtattttagttttgaattaaatgattttaaatattggatattaatttagaaattgggttattttttgggaattttattgaagaagagagattttggttggagagggggttttgatgtttgatatttatatttattattttaatattttattgttgttgttgttgttgttgttgtattattttgtgagttttgtttgtttaaattttatggtatttggtaggagagagttggatttgttggttttaggataagtttagaaataagaaatttgttttgagtgagtgagttggttttttttgttgttattttattattaaggatgaaaggaatttataaggattagagatatttggttgaaagtaatattagtgtgattggatatttattatttgttatagttggttatattgtttttagtatgattttgattgagtgagtgatattaggttatgtttagggattagggaggttaattatgtttatattgttttgtagtattttggtaagaattaatgattgtgtagatgtttagatttaggttagtaatattttaaaagtttttattgaattaattatgtttataagtagtttgtattttttattataataataatagtggaaaagttagttgatataaaaggagtttagattttatttaagtaaaaatataaaagtaaagatatttttttatataaattataaaagtaaagatatttttttatataaatgtttttataaaataagttgaattaaagaggaaagatgataggtaattgtatgatatgttaagaaagtattataatatttaagttaattttaattttttatttttttattttaagtagttttttttttttttattatttagttttgtgttttttaattttgataagtaaaaaagttattgtattaaataaattttattgaaatgtaggatttgattgagtgggtggggtaggtggaatgagggtggggaagttgagattttgtattttttagaagtttttattttatgttaaaatggttaatttattttaatattgagaagtaaggttttatttaattttagtttgtgtaagtttattttatatgtatattttttaaaattttaattttaggttttaggaattttttttttagttaaaatatttttaggaataaatttgaattgtattaatatataatttataaatttaatataaaaaattatttgaagtttgagattttaggttgtatgaaattaattttatatttgaaaattttttataaatttaaaagtttgtgtatttaaatataatttaaatatttgtgttatagtgatatttgtttttttgtttttttttttattatttttagagttattatttttgtatagaaaaattttttttatatgattttattataaatttattaaatatgatgtttatttgataatttttttaggttttttttttttttaattatattttaagttttagggtatatgtgtataatttgtaggtttgttatatatgtatatatgtgttatgttggtgtgttgtatttattaatttgttatttatattaggtatattttttaatgttattttttttttttatttttattttatgataggttttagtgtgtgatgttttttattttgtgtttaagtgtttttattgtttagtttttatttatgagtgagaatatgtggtgtttggttttttgtttttgtgatagtttgtttagaatgatgtttttgtttattgatggatatttggttggttttaagtatttgttattgtaaatagtgttgtaataaatatatgtgtgtatgtgtttttatagtagtatgatttataattttttgggtatatatttagtaatgggatggttggtttaaatggtatttttagttttagattttagaggaattgttatattgttttttataatgtttgaattagtttatagttttattaatagtgtaaaagtgtttttatttttttatattttttttagtatttgttgtttttggattttaatgattgttattttaattggtgtgagatggtattttattgtggttttgatttgtatttttttgatggttagtgatgatgagtatttttttatgtgttttttggttatataaatgtttttttttgagaagtgtttgtttatattttttatttattttttgatggggttatttgatttttttttgtaaatttgtttaagtttttttagattttggatattagttttttgttagatgggtagattgtaaaaatttttttttattttgtaggttttttatttattttgatggtagttttttttgttgtgtagaagttttttagtttaattagattttatttgttaattttggtttttgttgttattgtttttggtgttttagttatgaagtttttgtttatgtttatgttttgaatggtattgtttaggtttttttttagggtttttatggttttaggtttaatgtgtaagtttttaatttattttgaattaatttttgtataaggtgtaaagaagggatttagttttagttttttatatatggttagttagtttttttagtattatttattaaatagagaattttttttttattttttgtttttgttaggtttgttaaagattagatggttgtagatgtgtggtattgtttttgagggttttgttttgttttattggtttatatttttgttttggtattagtattatgttgttttggttattgtagttttgtaatatagtttgaagttaggtagtgtgatgtttttagttttgtttttttggtttaggattgttttggtgatgtgggtttttttttggttttatatgaattttaaagtagtttttttttaattttgtggagaaagttattggtagtttgatggggatggtattgaatttataaattattttgggtagtatggttatttttatgatattgattttttttatttatgagaatggaatgtttttttatttgtttgtgtttttttttatttttttgagtagtggtttgtagttttttttgaagaggttttttatattttttgtaagttggatttttaagtattttattttttttgaaataattgtgaatgggagtttatttatgatttggttttttgtttgtttgttattggtgtataggaatgtttgtgatttttgtatattgattttgtattttgagattttgttgaagttgtttattagtttaaggagattttgggttgagatgatggggttttttaaatatataattatgttatttgtaaatagagataatttgattttttttttttttatttgaatattttttatttttttttattgtttgattgttttggttagaatgtttaatattatgttgaataggagtggtgatagaggatatttttgttttgtgttagtttttaaagggaatgtttttagtttttgtttatttagtatgatattggttgtgggtttgttgtgaatagtttttattattttgagatatgttttattaatatttagtttatttagagtttttagtataaaggttgttgaattttgttaaaggttttttttgtatttattgagataattatggtttttgtttttgattttgtttatatgatggattatatttattgatttgtatatgttgaattagttttgtattttagggatgaagttaatttgattatggtggataagttttttgatgttttgttggatttggtttgttagtattttattgaggatttttttattgatttttattagggatattggtttgaaattttttttttttgttgtgtttttgttaggttgtggtattaggatgatgttggttttataaaatgagttagggaggattttttttttttttattgattagaatagttttagaatggtattagtttttttttatatttttggtagaatttagttgtgaatttatttggttttgatggatttttttggttggtaggttattaattattgttttaattttagagtttgttattggtttattaagagatttaatttttttttggtttagttttgggagggtgtgtgtgtttaggaatttataaattttttttaggttttttagtttatttgtatagaagtgtttatagtgttttttgatggtagtttgtatttttgtgggattggtggtgatattttttttattattttttattgtatttatttgatttttttttttttttttttttattagttttgttagtgatttattaattttgttgatttttttaaaaaattagtttttgggtttattgattttttgaaggagtttttttgtttttattttttttagttttattttgattttagttattttttgttttttgttagtttttgaatgtgtttgtttttgtttttttaaattgtgatgttagggtgttaattttagattttttttgtttttttttgtgggtatttagtgttataaatttttttttatatattgttttaaatgtgttttagagattttggtatgttgtgtttttgtttttattggttttaaagaatatttttatttttgtttttattttgttaagtatttagtagttatttaggagtaggttgtttagtttttatgtagttgagtggttttgagtgagttttttaattttgagttttagtttgaaagtattgtagtttgagaggtagtttgttataatttttgtttttttatatttgttgaggagtgttttatttttaattatgtagttaatttttggaataagtgtgatgtggtgttgagaagaatgtatattttgttgatttggagtggagagttttgtagatgtttattaggtttgtttggtgtagagttgagtttaatttttggatatttttgttaattttttgttttgttgatttgtttaatattgattgtggggtgataaagttttttattattattgtgtgggagtttaagtttttttgtaggtttttaaggatttgttttgtgaatttggtgtttttgtattaggtgtatatatttttaggatagttagttttttttgttgaattgatttttttattattatgtaatggttttttttgttttttttgatttttgttggtttaaagtttgttttattagagattaggattgtaatttttgtttttttttgttttttatttttttggtagatttttttttatttttttattttgagtttatgtgtgtttttgtatatgagatgggtttgttgaatatagtatattgatgggttttgattttttatttaatttgttagtttatgttttttaattggagtatttagtttatttatatttaaggttaatattgttatgtgtgaatttgattttgttattatgatgttagttggttattttgtttgttagttgatgtagtttttttttagttttaatgatttttataatttggtatgtttttgtagtggttggtattggttgtttttttttatgtttagtgttttttttaggagtttttgtaaggtaggtttggtggtgataaaattttttagtatttgtttgtttgtaaaggattttattttttttttatttatgaagtttagtttggttggatatgaaattttgggttgaaaatttttttttttaagaatgttgaatattggtttttatttttttttggtttgtagagtttttgttgaaagatgttgttagtttgatggatttttttttgtgggtaatttgtttttttttttttgttgtatttaatgtttttttttttattttaattttggtgaatttgataattatgtgtttttgagttattttttttgaggagtatttttgtggtattttttgtattttttgaatttgaatgttggtttgttttattagattggggaagtttttttggataatattttgtagagtgttttttaatttggttttattttttttattatttttaggtatattaattagatgtagatttggtttttttatatagttttatattttttggaggttttgtttatttttttttatttttttttttttaaatttttttttttgttttattttatttatttgatttttaattttttttttttatttgattgaattagttattgaagtttgtgtatgtgttatatagtttttgtgttatggtttttagttttattaggttatttaaggttttttttatgttgttttttttagttagttatttgtttaatgtttttttaaggtttttagtttttttgttaaaaggtttaaatatttttttttagtttggaggagtttgttattattgattatttgaagttttttttttttaatttgtgaaagttattttttgtttagttttgttttattgttggtgaggagttgtatttttttggaggagaagatgtgttttgatttttagaatttttagtttttttgttttggtttttttttattttattggttttatttatttttggtttttgatgatggtgatgtatagatggggttttggtgtggatgttttttttttttgttagttttttttttaatagttaggatttttagttgtaggtttgttggagtttgttggaggtttattttagattttgtttgtttgggtattattagtagaggttgtagaatagtaaatattgtagaatggtaaatgttgttttttgattgtttttttggaagttttgttttagaggggtatttggttgtatgaggtgttagttggtttttattgggaggtgttttttagttaggttatttaggggttaggaatttatttgaagaggtagattgtttatttttagatattatattttatgttgggaggatttttattttttttaaagttgttagatagggatatttaagtttgtagaagtttttgttgttttttgtttagttgtgttttgtttttagaggtggagtttatagaggtaggtaggtttttttgagttgtggtgggttttatttattttgagttttttggttgttttgtttatttatttaagttttagtaatggtggatattttttttttagttttgttgttgttttgtagtttgattttagattgttgtgttagtagtgagttaggttttgtgggtatgggattttttgagttaggtttgggatataattttttggtgtgttgtttgttaagattattggaaaagtatagtattagggtggggagtgttttgattttttaggtattgttagttatggttttttttggttaggaaagggaattttttaattttttgtgttttttgggtgaggtgatgttttattttgttttggtttatgttttgtgggttgtatttattgtttgataagttttagtgagatgaatttggtattttagttggaaatgtagaaattatttgttttttgtattatttatgttgggggttgtagattggagttgtttatatttggttattttggaatttttttttttaagttttttattatagagtgggttattgaaattttatggaataaattggaaattatttttttaattaatgttattgtttattatgtatgggaatttggtaaatattatatggttttaataatatagtagatagaatattgttaaatttaaattttagtgaattgtaatagattttatttgaaattttaaagaaaatagaattttaattgaagaggttaaatttttatagggaatgttaattgttatttgggttttgtaaataaaaaattgttttttaaaaaagtaaattttaaaagtatttttagatgattttatttgttatttaagtggtttgagtatgtttgatgttaagatttttttgttatagattggagatgtgtgttattggggtagtgttgttttgtgataaggaggtagaggatgagggtaaggtttgatgtgattgtgaattttgggtggttttggttattgggagtttttattgattatagtaaaatagttgtttttttagggtaatagtgtttttgttatttaggttggagtttagtggtatgattaattgtttattgtagttttaattttttagatttaagtaatttttttattttagttttttaagtagttgaaattataggtgtgtattattatatttaatttttttaatttttaagtttttgtagagatatggttttattgtgttgtttaggttgattttgaatttttgggttttagtgatttttttgttttggttttttaaagtgttgggattataaatgtgagttattgtatttggttttttgtaatttttttgataatgtatttttttattttttaattggaagtaatttttttttttttataaaattgtatttgtattttttttgggttatttttatttttatattttagttatgtatgttttattttttttttagggagggaggtaagtaagattggaaagtagattttatgtgtgatgaatgaatgaataaaaggaagtttaatatatggatatagttaattggatgtaaattaaaaatttttaaatattgatttgtaagattttattaaggttaatttttaatagtttgtattatatatgttaggaattaaatattaataatttttttagtattattattatttttataggattgtttaaaatgagtagttatatttttaaattgtgttttttttgattatatgtttataggtaaaatttaaaggggttgggaataaataagatttttttttttttttgtatgtttgaattatttgtattgttgtttgtttttttatttttggttatagaaatttagttttaatatgttataatttttgtagtttttttttttagaaaaagattatattgtttgaaattttatttatttaagtaattaagttttaaagttgaaggattttggttatgattaatttagatttataaagtagtattttaatggtattttttttagaaagttaggttttaggatatatatagttgtagtgtttatattttgtaagtttttttgttgttatagttatttttttttttgtggttgatattttaaaattggtaatatattttgatggtaaaagtttggtttaggagataggtgatttattagttttatggtatttgataggttatttaatttttttgatgtataattgttttatttatataatggggataataatatttattttgtttttttgtaaaaattaaattagatgatgtttgtgaatgttttatagttttttagataaatgtaagttatgattatagtaagagtaaaagagtatgttgttatggatatttttttagtgaaatgtttaagatttgtgagttatatttaaagttaaatttgatatttattttattgattttttttttagttttatgtattatattgaattttttgatagtggggttatgaaagtttttttagtattttatagatgtggttgaattaatggttgtaagttttaaagtagaattagatagtattaatgaatttattaagtataaataaatatataatttgtttagtaatattatatagtttttttattttatgtgtgataaagagttatttgaaggttgaaaatgaagaattgttttggaagtttttatttaattttttattattttttaatatagtatataaaattatttattgaaagtttagtagaataagaaataagaagttaaaaggttgaaaattataaattttgttattattattgttattattttttaagttttttattgatttgttagaaatagagttatataggaaattgtaggatagttagtatgtggtagtgttatttgttttttaattatttaagtaaggttttattttattagaggaatttaagaagttggttatggttgataattgttatttgttaaattttttagagtagggatttgtaatatttaggttatggattgttattagtttttggtttgttaggaattaggttgtatagtaggaagtgagtggtgggtgagtaaatattgttatttgagttttgtttttttttagattagtagtagtattagatttttatagaagtatgagttttgttgtgaattgtatatgtaagggatttaggttgtgtgttttttatgagaatttaattttttatgataatttaattgatgatttaaggtggaattattttattttaaaattatttattttgttatttttagattgtggaaaaattgttttttataaaattggtttttgttgttaaaaaggttgggattattgttttagagtttataatttggggttagtatagtttatatttatttgagaattttaatgggtttattgatttttttaaatgaaaaggttttttatgaaaattatatttaaattgtttttttttttagtttaataaatttattagtaagtttttattgagtattgttattatatttttttttgttaagtattatgggggtttagatatgatttatttttttaaagaatttattttttagttgaagattgattagaatgagtaaatatggttaataattaataagtgagtaggttagtttggttaatatggtgaaattttgtttttattaaaaatataaaaattagttgggtatggtggtgggtgtttgtaattttagttattttttgttgaggtaggagaattgtttgaatttaggaggtggagattgtagtgagttgagattgtattattgtattttagtttgggtgatagagtaagattttgttttgggaaaaaaataaaataaaataagtgagaagggaattaagtattatgtaagatgtaatgtggaattttagggaaggaaggtagtgtatgttggagtaattagagaaaggggtatgtatgatttgatgtttgaattggattatgaaggataagtaagattttggtagtaagtgagagggagagaggagtttgttagaggaatggaataagttaggaggtagtaatgtgtatggtattttaaggattttgttttgattggagtagaagtgatgaagtattgagtagtttgagaaagttagttaagaagggtgagggtagatgttggagagagttgagtattagagagaagatattagatttgagtagatagaataaaaatgttattgttagtttttgtgtaagagaatagtattagggtggttatttaggaagtggttattagagttgaatggagtagaaagagtgtttgatatagtattgggatgttgtggttataaaatgaggtggtgagggttgagttaagatggtggtagtgggatggataaaaagggatggttaggataaatattttaaaggaaaaattaataggatatttttattgattggattggaaggttatgtaggaaatatattgttaaatttgattttaggatttttattttatgtttgggttgtttaaaatattagggaattattgttagaaaaggtaggagatattattgttttaataaaaagtattgagtttggtgttgtatttatttaattttaaggttttataagtgagtagatagttagttagaattgtagaagtgttatttagagagtagggtttgtaatgtggggttggattttgttattattgtgttaatttttaattttatgtagatgtttagtttgaggaatatttatgtttgggttttagaatgaaagttaagtaatatttatttagatgttaattttttttttgaaatatttgtttatggaattgagagaataatatataaagtattaattattttttttataaagttattaataaaaagataagattagtgaaaggtagagtaaattagaagttaagtatagaaaatggtattatttaaagatttattattgtagtggtgaaaataaaataattttttaatagtttaagatgttttagtattttggattatttttaagtagttagtgtgggtatttagtaaatatgtattaaattatagtttattaatttttttttttttttttttgagatggagttttattttggttatttaggttgtatttttgtttttttagtgatatataaaatgttgagttttataatgatggtattttagatttgattaaatatggtattaaaaaatagttgattatagaaagtttttattagtgtgatgtagatggttaaagtattttatatttgtaaatttttattgatttaaataagaggtgttttttgggttgtttttatttggattgggaatattaggagaaagtttttttatttagtgtgtaagtataatttattagaaatagaaatttttatggatgatttatttttttgatggtataggatttagaatatttataaagatttagttgttagtggaatagatatttgtattttatttaaattaattttttttttttaatttgagaatattgtgtaatttaagtagttttaagtatgtttgttatttgtgtaaagtgagagtaaatttaaaagaaatttttttgtgtgtttagggatggtaataaagttttttagtggttgaaaatgttattttttataaaagtggagaatatttgttttttaatattagagtttttagttatttttgtattttgatttattgattggaggtaggttgtttttgaatttagtaaaattttatgggtagaaatatagtttttttttttatttatttggatattatgatggttattgtatgtatgtgtttttttgtaagtttatgttttagaattgagaagtaggaataaaattagggttagggttggggatgttattttttgttgttgagaaatataatgttttaggtaagtgattttgaagttttttattatttgatggtaattttgggttggtttataggtatgtttttattttgtttgtttatttattttaattggttttttagagtatgtttgtagatgtagagttaaatttagagtagagtaattttttggtaaataggaagagattaattttgtggtatgtttttaagggattttttaggaaattttaaaagtagaaaaagaagtattagttgtttattttaaaatgtgtaaaatattatttagttttttaaaagtaggataaatttagagtgtgtgtatatgtgtgtgtgtatatatatatatatatatagagagaatatttttagtaaaaagaaaagttgagtttttttagttagatgtgtgtattagttagaaaaagttaaggagtgaagggttttagagaattggaggagataaagtggagtttgtatatgggaggtatttgaaatggatttaaatgtttttttaatgttgatttttttagttttttttttattagatatattgtttttatgatattagttttaggtatagatatattattaaaatgaatatgttaaaaaatgatttttgtttagaaataagtaaaatatttttagttgtgattatttaggtgtagaataaagaatagtggaattgggagttttgagttttaatataaattttttttatgatataaggtaagttttttatggtttttggtttttttatttgtaaaataggatggtttaatgaaattattttttttttttgttataatagagtatttttgtgggaagaggaaaaaaaaagttaatttaaaggttttttatagttttttaattgttgttttattgtgttatttatgtttagatattatatagttagaaaggtttattagattttttaggttattgttgtttttgttatatatttttgtaaaggattatgttgttaatttgaaaaaaattattattaattatatttgtagttgttgtttagtaatatttatgattttgtgttttttgtgatagtatgagtagagattattaaaaattaaatttataaagttgttaaagtgggaagaaggagaatttgaagttataatttttgtatttgtttagaagttatttaattttaggtttatatgttagattttgggggaaatattgtatgtttttggtttatattaaattatatatagtatattattgatattgatttgtgtttggtgtagttggagtttattattaagatataaaaaaattttgattttgtagaatggtttggaattataattagatgggttatatggtattttggtgaaagaaagttttaattagttttttgttttgtttttgttttttttttatagttttattaggtgagaagagtgatgattatttttttttttattatggttattttatattttggttgtatgaaggttgtttttatgaaagaagtaaatatttgaggataaggtggtttggtttatttaggtgtgtggatttatgggattttggagagtgtgaatgggtttaaggtaggtttaagaggtttgatattattggttgatatttttgaatatgtgatagaagagttgttggatgaggattagaaagtttggtttaatgaagaaaataataaggatgtagatttgtatatgtttagggtgatgtttagtagttaagtgtttttggagtttttttttttttttttgttggaggaatataaaaattatttagatgttgtaaatatgtttatgagggtttggtgttattttgattttgtttgttgaggggagttgagtgtgtgtgatagtattagtgagtgggtaatggtagtagataaaaagattgtagtggatatgttgggtgggatggttatagtttttgaaaaggtttttgtattaaaaggttaattgaagtaatatttttatgagattaagtgtaattttatgggttatataaaagaaggttgtaggggtatagataaaaggtattggaatttttagtgttgaattatttagttgtatgtgtgggtttttattatggatagtaaaaagagaattggttggtgatttataaggatagatattttttgtgtatgtatattgattattaaaaggggaagatagtggatttatgttgtatagattagattatattgagataaaaattatttatttgtatatatatataatagggtaaattatttagttaagaaaaaaataattttatgaattgtatgtataaatgaagtttatatagtatagtggttttataatttatttattggatatgtttatgattagaagggaaatagttatttgtgtataatttaaaaagtttgtattatattttttgataatgttgtggtttgttgttgttgttaagaattgaaaatataaaaagttaaaaaaaataataaattgtatgttgttttaattgtgaattgataataaattgtttttttttagaaaatagaaaaaaaatatatatatatataataaaaatttgaattaaaatattttgtttatattttagatagtaagtatttttgtttttgttagtattatatttgttttattgtttttaatttttgatagtgttggaattaaaataatgttaaggtgttgttgttattgttttattggtttaggggatgggggatggggggtatatttttgtttgttttgtgttttttttttgtttgtttgttttgttttttagtttttatagggagtagagatggggaaagaatttttataatatatattttggttgataaaagatatatttgtatgttgtgaagatgtttgtaatattgattagatgattagaaagtgaataaaaattaaggtaattgaataaaaaaatgtttatattttatattttgtgatgtattttttaggttttgtttattttttgggtgttggttagagtaagttgtttttgatggaaggatttatgtttgtttagaatatattttttttttttttttttttttggttttttttttgttttgttttaaggaagaaaaattagttgtgtgttttgaaatattttattattgttgtgaataagtgaatatattgtgttatattatgatatttgtataagtatggagaatagtgatttttttttagaatagaaaataataaaaaataattttaaaatgaagattattttttatgaggagtgaatatttgggtaaattatggttaagtttaaaaaaaatttatggtgaggtttaataatgttttgtaagtaaaaggtagagttttgtattaatttagaaatatttagattagaataggaatttatattgttagtgatatgagattgaatagttaaatggaggttatgtggagttggtattgtatttattggtagtgtgggaggaatttttgagtggttattttaaggtttaggtggaggtggggtatggtatttgagatattttaaaatgaaggtttttgaaggattttttagaggtggttttggaatgatatgtgttaagttgtttggattttgtgttttaagtgtttatattatttaattgtgtttaagaggtttttgattggaggattatatttaagttgatttatgtttattattttatttttggataattttgtataaaattggattagtttggagtaggttgggagttaaatgtggtatttgtgattatgagattgatgtaatgagatagaagatgtttgttatttgaatatttattgttttgaaattagatttgaggaaattagggtttattttttgagaatttttggtaagggaaaagggaataggaaaagaaattttaaatttaggttgaatgattaaggggatttataggaaattttgtttagagataagattttgggaaggtgtttggatatttagaatattaagatttgaaggtgttttgtttaatggaagaggttaggatagagttgataaaattttgttttttagtgaaggttatagtaattttttgtttattttgtttgtttatggagagggtttttgttttatttttgttattttgggttaggagaagttaagttgggagtttgaaatagtggtttttggaaaaatggatttttagtgaaaattagagttttaagtttatttagtttattttatatttgaaaatgttagtgattattatttggattagtatttttaagtattagaaagttttaagtaattgttgtattttagtagggtgagggataagtaaaagaggatgtttattataatttaggaatgaagatattattagtaaagaattttaatttgtttagttttttatttagagttagttttttatagtattatttgaatatttttttgaaagaaggaagattttatgtagtgtagatttgttttgtgttgtttgaaaatattatttttgtaattatttttaatatgtaaggaatgtttggaatatttgttgtatgttaattttatgtagtttttttttgagggataaatttaaaataaataattttttattataaatttaaaggattgtaagggttagatttgttaagtggttttataggagatatatttagtaattgtgtggttagtggtttttttatttaataagatatattatagttatatgtttgatggtttatgttgatttaagatttattttgttaaaatttttttttgttgtgtttgtttttgttttgttttgttttgttttttaaagttttgttgtggtttttttgtggtagaagtgttttatgtatggtagtaggtttgttgtttttttatggtgatttttattgaaaatgtaagtaaatgtttgtggttttgttttttttatggtaaagatattatttattatgtaaaataaaaaataatatttattgtattttagtatatttatataattatgttattgaaaaaaattggtattaaaatttaattgtattagaagtttattgtaaatataagttttatttaagtgtattaattaatatataatatatgttttaaatatagaatttttaatgtttttaaatatatttttaaagtat

SEQ ID NO: 230 - DNA, 67922 bp, Artificial Sequence
  Chemically-Treated DNA
gagagttagagttgattgagttttagaatttggggaggtaggtggggtaagggttggggtttgtgtgtgtgtgtgtatgtgtggaaagtataaatttatgagggtttgttgttggtagggttaaggtgagtgagtgaaggtggtagatttgtgaagttttagttttgtggatattttttttttaagttatatagggatttaagagaaattgaggtatgaagttggggggtggtggtggtggggattttgaaggttgagttgataaagtttagttttgtgtttttgtttttttttatatatttgagatttttataggtttttttttaggggtttttgttttgttttgtagttttttttggggatttgggttttgtggtttagtgtgatttgtttggggttatgtgtttaagtatgaagtttttgtgtggagtttatgttttttaaaaggtttttaggggtaaagggatgaagtttaggagtgttaatgtgaggttaggtttagtgggttagggttatgaggttagggttgaagttttagaattgatttgggagtatgattaataagtttaagagatttgtggaggttatgtttagattatgtttattttagttttttttgagttttgtttgtttttttaagattgggtttttttagtttgaagttttatttttaggatatttagttttgtttttttttttttttagttttgtagttaagtttaattttagggtgggagattaattaggtggagatttgggattttgttttgggattttttggtgataatttttatttttgtgttgtttgtttttttttttttttaggtttgtttagagttgagttttgttttttggttgttgtttaaattaggggttgtggataaaggatgtttggggtttgtggttttatgttaggattttgtgttgaatattttgattttttgggttttttttaagggagttttaaagattttaatggttaataggaaagtgggtttggtttgggtagtagtttgattggttttagtttttgggagtggatttaggggtaaggggaggggagaggggtggttttgggttttggggtgggaattggattttagttgtggttttttttttgtgtttttgtttgtattgttatggtggatggttaatgggtgtgtggtttggggttggtggtgtttggtgattggttgtggggttgtttgggggtggggttgaggtttgaagttgaagtgagggatttagttgtggtgtgtgtggggttttttgttgttgtttttgtttgtttgttttgtgttttggttggaggaggaggttgtggtgttggtgatagttatggtagtggtagttattgtggtggttgtggtggtggtatttttgtttttatttttgtttgggattgttttttattgtttttttgttttttttggatagtgagtttgtggtggggtgggggaaggagttgtttttattttttttaagtttatttttaaagagattttttttttttttttttgttgtttggtgtggagttgggatgatgttgattttttagatttggttttagttgtgttgtgggaagagggggtgtttttttttggatttttgttttttgttgttgtttttttttttgtttgtttttttggggtggttttgttgaaggtagtgttgaatttggtaattggagtttgggtgtgaagtgaagaagttggaataaagtgagggggagttggttggttggtttgggaagttttaggggtgtaggggaagtgggatttgtgttgggtggggtttttttgtgttttggtgttttgtgggtagtatgtttttgtgggtagggggagttgggttgaattggtttttttgggggtttagtttgtgttttagagtttattagatgtgtttttgttggggtttttgggttgtgtgaggatattttttttgaggggtgttgtttgtttttttttggattgtttggggttttggttggttagaggatggatgaggaggaggatggagtgggtgttgaggagttgggatagttttggagttttatgtggtttaatgatttgttgggggttgggggttggttggggttggggttagtagaaaaggatttgggtagtgtggattttgaggtggaggggttgttgtatttggtgttggttttggtggtttttttttatttgagttaggatagttgtttgtggagttggtgtttttgtatggtttgtaatttatattttttggggtatgatggttaggtgtggggttagaagggggatgggttgtattgttgggggttgggggggaagaagatttattgttaggtgagttgaagtgagtttggagggtaggtggatggggggggggttgttagggaggggagggggtattagagtgggagtggagatgtgagtaggttttgttggtaatttgggtttattttatttgtgtatatatattttagtttttttgggttgggggggtggggatttaggttaggagaagagagttgtgttttgttggtttgtagttggatgttttttagatgtggttaggggagggttgttattttttagatgtgggaagttttgggagtttgggagttgtattttgtttgtgttggttagtgagttgggtttggtttttgagtttggtggggggtgggtgggggtggtggggaggaagttgtggggatggaggaggggggattgtaattttttgggttttttttttttttttgttttaaagtttgtggtggattttagggtttgattttttaatttggtttttgaggttgaggtttttattgatttagaaggagatgttggggggtggggattaggttttggtttattttattttttattttgtgggttggaggtataataaggagattttggtggtggttgatgttaggggtgtagaatgagaataagatgtggtggaggggagttgtttgtttttggagttgggagtggagtttttttttgttagagtttagtgttgtgggtgttttttatttgatttttatttgatgtagggtgtttaagattgggttggggagttttatgttggattttttttgtggagggaaagattgtgttaagagtttttttagtaagtgggggatggggttaagttggtttaggttatttttttttttttataaataaagagtgtttttgtagattaggtatgggggattgtaggtttgtgaaagttttgaggggatagtaatattgttagtgtgtttattaaggaggatttgggtttattattttagtgtagattttgtagataggtttggggaatgtaagttttatattttagggagatggatttagtattgttttttgtttgtttaggttggagtggtaggggagattttagtttagttagattttagtttaaagtgttatttgatagatgtttggttttaagttttttggtgggttttgttattgggggaaggaaaggtggaggggaggtgttgttgttattttaggtttggatagtttttttgggttttttttttttagtttagaggtttttatagatttagggtgggagattttaggttttttttgtagtttttgtgagtttagtagggattttgttttggggaaggggggtggaaggttggtgttgtttttattttttgtagttttgttgtttttagtgtgtaaagtagggatgagtttgtggtttttttatttttattttttatattttgtgggtttttaggaagttttttttattatattttttttttatttattgttttttttttttttttttttgagttgtagaaagagaggtgtaggttttagaggtttgtgtttttgttgaataggtataattttgaggtttgagtttttagttttaggttttttttttttaggtagggatggagatggagaattgatatggttggaaaggatgggttttgagtaatttttttttttgtttttaattatttattttttttatgaatgggaaaaagtattaatttttatgtttttttttttaagggttttaggggaggtagagagagttttttttttttttttttttgaaaatagatttttaggttagtatttttttttgtttgttttatttttaggtgttagtggagggtttggaggtagatttttttattgagtggtttggatgggggtaagtgttgaggtttggtatgggggaggagaggtgggaggatagtatttattttgggagttggggagtagttttttttaggggagtggtagttgggtgtgtggtattagtattattaggtttggagaagtttgggttggttgaggatgggttgagaataattttttggtaggggattgtttaagttgtgttttttattattgttattttatttaagtattaagagatatttgtatttttgttgttagaggggttttgaattgtttttagggtttttttttttttttttgtggtatttgtgattttttataggttttaggagggtttttgtatgtttttgagttggagggatataaggatatttttttttatttttaattaattgaagttagttaggttttttttggtatattttgttttttggttttttttttttaagggattaggttttttagagaggagatttagatttaggtaggaagtgtgtgtgtgtgtgtgtgtgtgtgtgtgtgtgtgtgttgtaagggaggatagtaaaaggtttagaagtgtaagttttggtgtggagagtaggggtattggtagatagttatttttgttttagattagaggggagtatgttggtttttttagtatgtgtttttgtaagtgtgagggagtgtgttttttttttggggaggagtttttttgtattttttttttggttgttgtgttatatttggaagtttgtgtaggagtttttttaagtttagagtttagtatagtttttttttatttggaaattataggttggtatttgggatgttgagagagggggagtgggaggggggttagagggggagaggggagtttgttaggagttgggggaggagaggggggggaggtttgaatggtaggagttttaatggtttttagaagtgagtgtgagtgagtgattgtgtgttattttgtgtgtttgagtgtgtttttttagaggggtgggggtataggagtttttggagttttttttgttatattgttttaatgttttaagtttgtttattttttttatttagggagaattttttatttttgtttttagaggaaatggtggggggagtgttttttttgtttttttattaatttttttttttaatttaatttttaaattttaagtttattagaggagattttggggagaagggttggggttggagaattgaatgggattgagggggggttagattattttttggtatgttttttgttttaggtttattttttttttgggttatatatatatttttttttatttgttttgttttattgttttgttgggggattttttattatttgtagtgttagttggagttatttttgggattatttttattatatagttttttttatttttgtttgtttttgtttagtatttattttgttttgtttgttttagttaggatggtgatagatataattgtttatatgtagatatgtgtatgtgtgtgtatatatatatgtgtatatatatatatagagttatagatgtttgaattagatttttggtttatttttttttttaaagattttagtgggttgttttttttgtgtttttgtgttttatgtttttgtttttgggtggagttggttgtttttttgtgagttttagtttttaatttagttggaagtttttttttttttatatttatgtattgaagtgtggtgaggggggaattatagggaaataggtttgtggggtggggtggggggttttgttgggggaatttttttttgagttttggagtagggtggagtttttatattttatgttattttaggggttgttgaatttgatagatattaggagtttttttgtgggatgggtgaggtaaggatttatttttttatttttttatttattagaaggttaggatttttgggtttaggtttattttttttttaatgttttttagttttatatttttaggtttttaggtgggaatggggttgttggagggtttgtttgtttttttagtttatgtttagagtttttgtgtttttagaggtgttttagttattttttttttttttttattttttttatttttgtggttgttaggttaagtaagggttttatttagataaagttttatatagaggatttatttgtggagataatatgttttagtttttttttttaggagggaggaaaggaggagggatggaagtggggtttttttttttgttgttttttttttttttgtttttgatggtgggttgtggggagaagaaagattttttttttttttattttttttttgggatttattttagtttggatagttattatagtaatagtagatatgtgattgtataggttttttatagttattatggtaattagtgttttttgtttttttggttattatggggatttgttatatggtttttttttaatttgataatttgtgggtttttttgattttttttttttgtataaggataagataatagttttagttaggggagattatgtgagaggggtttttttaattattatgataataaatttatattatttggtgatatatttttttgttgttatggtaatagaagaatattatatagtgatatattgttatgtttttaaggaaataagttttattttgagaagggtgaaagattttttttttattaattatttttttatttagagtgttttaaattgttgtgtgttttggttttttttttgtttgtttatgtttatgtgttgtggaaggagagttgtatagggtgggtaggatgttatttggaagtaggttgaattgttaagggatttttaagaaggggttgatatgattaagagttgtgtatgaggttatttgggggtaggttttgtttgtaagaggtttttagtttgagtttgggtaaggtggggatagaaagaggggtaatttttttgtgaggttatttttgtatttttttttagttataagtagtttatttttgttaagggaaataaggtaggaagatttgaatggggatatatatttggtttttaggtagggagatttattgattggttgatttgtttatttatttatttagtttttttaggtattgattatttgttttgtgttaggtattatagtaagttttgtaggggatttaaagatgtattagaatgtttttgtttgttaggagttttagtttagtaggggaggttgataagtgtatagattattaatatggtggaattttgttattagaggggtttaagtagatgttttgggagttttttttttttagagatttattgtttttatatagagatatttatttattggggttttttttagatttttttttttttgtagaggagaggaggggatttgtatggggaaagtagattagtttttgagggtaattgtgtttttttttttttaaatgatggttttttttttgtttttttttttttagggtgatttttggttgatttttattttggggagagatttattgtattttggttttatttagaaaaataattttgtggaaatagagtattttttattttttttttgttatttgtttatttttaaaaatttagaattttttttttaaatttttttatttttgtgagggggtgggggttagggaaattgtagtgtattaggatttttggggtattatggataggtggtgagtaggtatgtgagtttaggggagaagggtttgggtggtggagaagagataggggagggttgttaggggtttgagggatttatgggttatgggggagggtatgtggtttgggagttagaatagagatgggttatggttgggattagttgggaggaaggtttataggtttttgaatatttttgttggtttttttatgtttggttaaagtttttttattttagaagtaagattttatttgttttgggttttatagagtttggtttggtgggttatgttaggagttgttataatattttttttatttttattttttagggggtttttggttttttttttttaattttttgttttttgattttttttagtttttttatttttttttattttttttatattttttttaaagaaaataggatatttggttatttaattgtgagtttagtgtttggaattttttaaggtttggaggttgttttgtatatttttttgttgatgggttggaaatgagttattttatagaatttattgtatggaaagatttagggtttagaaagaattttttttttttgtttgttgttttggttggtttgggttggaagttataagtaggtgtgatggtggtaatggttttttgggggagggggtagatattgtttattttgtatggtttgggagttatgtttagtatggtgtttgatatataatgggtttttaatatttaaatgtgtgaatatgtttagtggttatttgagggtgttgagaggttgggaggttggtggtggaagagggagttttgggttttggtgttgtagtagtggggattgtagttgtggatgtttgttttatatttagtgttagggtggttatgataggtagttttgtttgtttgagtagttatggtgtgtagaggaaattattatagattaggagtttggaaattattgttttattttgtttttttgggtgatttttagtatatgattttggtatttttgggttttaatttttttgagttttggggaagaaaatgatttattttagatattttatagggttgttgtgagtattaattgtggtattgtgtgaaagtgtttggtaaattgtaaggtaggtataatttgattttaggtttgtataatatatttatatatagtattttatttgttttttatatttattttgtgaggtagggagaataggatttagattttgtagtaaatttatggtgtttggtatttttataggtatgattgatttattttttaaatggtttgtgtaaatagttagggtatttgtggtttgtttttttttatagatgaggaagttgggtttagagaggtgagatgattaaggtgggattttttttttttgatgaggagtttggggttgggggttggtttgtgtgtatgttagggttttggtattatatttgtttagttttagatggagttaggaggtaaatgaggaggaggtgttagggtggggttggggggttggttttagttttagttttggttagttgtttttttgattgttagtatttggtttgagtgtattagtatgttggttattttttttaattgtgtgattttgggtatgttttggttatgtgaggatattgtttgtgatttttagtgttgttggattttgtaggtgagtgtgtgtgtgtgtgtgtgtgtgtgtgtgttgtgtgtgttgggggttggttttttttaattttaatattttttatttttttgtaagaggttttgatttaattggtggggattagggtgggattagagggtatttttttatttatgttttagttttagttattttttgtttttatattaggtttttgatgattttatttttgttttttttgttgtggagatggtggtgaagatggtggttttgggtatttttgggaaaaagtgttatttgggagatatttggaattggtttgatttttttattgttattgtagggtgaggatttgggttggggtgggagagtaatggattagattggttttttttttggggttagggttttgggtttgtgattttttagttttagtttagttatagtattattttttttttggttattttttgagggtttgaggttgttttgtttttagtattgtagtttatattttaaattttaaggttttatttttaattttgtttttttttttgatgggtaatttgtttttgttttggggtagttttgttttttagatagagagttggatttttagggttttttggtgaagaagaagaaggagttagaggttattttgttgtttttaaagtaggattttttattgattttttttgattttattgtggttttagatttaaagggtttttttttgggtttttttttgtaggatgttggagtatttgttggatttgtagaatgttagttttttagttgttaggatagtttgtgtgttgtgattgtttagggttattaattgggtgtttagtgagtgattttttagtttttagtttttgaagagagttttaggaggaaatgtggaatttttagattttatttttattattgtgtttttatttgattttttataggttttgttagagaagggtttagtggggagttgggattgttggaataaaatggaatttttgaatgtggtattatgggagttatttgggaaaattttattttattttagtttggttttaggttagagttttagaaatattttagatgattttttttttttagttagatgattattttttttaggaggataggggtgtggggattggagaggttgataggtaaggagtggatgtaaagtgttaatggttttttttagttagaatagttttttatgtaatttggtttttgttggtgagatatgttggttatgttgaatgtgattttttttaagataaggttattttatgttttattttttgtttttgtttttttttttttttttgtttttttttaatttattgtagtaattgttgggtttattatttaaattaaattgtattggtttttggagttagtgaggttttggtagttttagttttttttatatattgttttttttttttgtttaggttttttttgtaattttttaatttatataagttgtagatggtttttgttgtggttttaggagtggggtggttggtgaggaatgtatgtttttggggtttagtgtttgtttgtgtatttgatgtagtagtagttttttgtgttttgtgtgtgtgtgtgtgtgtgtgtgtgtgtgtgatgttgttgttgtttttgggagggtagagttgttgaatgtgttttttggggtttggggtgtgttggtgttaataggagttttagaagaggggtatgttttgtttttttttttgttttaggtgatggttggtagatttataggtttttgtttaattattggtgtaatttttttaatgtaaattttgaggaattgattttagttggagtatagagaagttgaagggggatggggtaggaggagggggagggagattgagtgagaaaattgggttggtaggggtgaggttgggtgttgtagttattaagagggttaattagttgttgtttagtagtttttgttttggaggggttagggggttatagatggtattttgggggtgaagttagttattagagatttgtttgtttgatgagggtttggtggattgggggttggtttagattatttgggttggttgggttttagatttggagtatggagagagggaagtaattttaatagggtttttgaggagggggttttagtggttttttttatggagggggttgtaaattgatggatttttgagaagatagtattgtatttttttaggttttgatttggggatttggattaagtagggaatagttttagggaagtagggtttagagttatagtgaagtatagggtattttggtttttgtttaggagttggtttttaaaatgagatttttgtttgttgttattttttttggagtttgttgttttagtttttttaatgattttggtggtgataatttagaaaggttaagtgattgtgtttgttgagagaaggaagtaggtagggagtgtgtgtgtgaatgtgtgtgggtgtgggtgtgtgttggagagggatttggaagttaaagtttgggtttgagttttggtatttatatttagtagttgtgtgatattgggtgagttaagttatttttttaagttttagattttttatttgtgaattgggagtgatattatttatatgtgatgatgttgggagagttaggaggggttatagtttttttagtttattgttggtggtattgtgtagattattgtgggtaagttataaggggaagtgggttggggtaaggggttgtagaggttatttggggagttagaggtgtttgttggttttttttttagtttgagttgggttgttttagttttagagtttttggtggggtttttttgggagtgttgttgggttgtggtagttagtttagtttggttagtttggtgtttttagtgtggtttttgtttttataggtatgtgtatttttgttatgttgttgttggatatgttgtttatgttgggtaatgttttgttgttttgtttttttgttttttttatttttggtattgttggtgtttagttgtgggtagggttgttttggaattgatgttttttatttgagaattttagtttgtgagtggtggatagggtttagggaggatttgggagtggttatggggttgggtatttttttaagttttttatttttggttgttattgatatatttgttttaatatttgagatatatttggtttttaaatttggttatttattggaattatttggggagttttaaaaagtattgatgtttgggtgttatttttagagattttgattttattgttttggggtttagtttggatgtaaggatttttttaatttttttagtgattttaatttgtagtgaaatttgaaaattattattttaggatgtgattttttaatattttgagtttggagtttttttatttaggttttatgtttttggtgtttataaatttttgttttgtttagttttttttttatttttggttttgttttgtttattttatatgttttgagtatttgtgttatttttttttttttgggttttttttttggagagtttattttttagttttatttttgtttttttttttattttgtagttttttgagtgtggatttggagtgttattattagatagagaatgaggatgagagtttttttatttgtttttagttatgtgagaatggtatgtggttttgtagaagtgtgtttatgttgtgtggggatgggggtggtggtttattttgtggtttggattatgaggtttataatagttttagtaatattatttgtgttaattggaattagtattatattaattgtttagtgggggagtataatttttttaagggtgttattaattttgataatattggttatgtttggattgttattttttaggtggggtagtttgggttttgggagtttttttagaatattagttttaggatatagtttaggattggagtggttgtttttagggttggggtgggggttaaggtttttggaggagattgaaggaggatttggtgggtttatagttagtttgtttttttgtattttttaggttattatgttggagggttgggttgatattatgtattttgtgatggatgtttattttttttataattttatttattttattttttttattattgtgagtgattttttagatttttgtggggatgggtgattttggggatatttgtgggggtagtttagagaggggatagtttgttttgtttgaagtttttagtttttaggataagttttgtagagagggtatttattatatagtaggagggatattagatgtagagttaggaggaaatttaaggttaaggtgggatttaattgttattgggattttgggtaagttattttttatgaggtttttagtattgttttgggtttttgtttttttatgggtaaaatgaatggtttttaatttgagatgatattattttttttagagggtatttggaaatgggaaagggtgattttggttttgattttttttaatagttttattgagatataatttatatattatttaatttatttttttgaatgaatttagtggttttttaagtatgtttatagagttttgtttttttgtaaggataaggggagtgtaattggtaatttgttattgggggaggggagagaagttaaatattttgaaatgtttgtaaataaagaattattttatttaaaattttgattagtgattaattggtgttaaatgttgtttgattttttatttttgttagtttagaaattgttagattttaagaaggtagaagatggaggtaaaagtagtaatatttaatagttttaattattattatttatagttaataattttattgttattattttgagttaatatttattgagtatttattatgtgttagtttttgatttaagtatttttaatgtgttggtgtatttaatttttattgtgattttttttattttatagatgaggaaattgatatttttttatttatttgattttattagatgttttgtttatgttgtgtattaatttttaagagtggggtattattgttgatgtatgttgtaatatttgttgtttgtttaatttttgttgttttttgtgaggtgttagggtagggattgtggtttttattttttaaatgagaatttagtgttttagagggtgggttattgggttaagattatatagaaagtaagtggttggggttgagaatttagttttaggttaatgattttatatttagttttttttttatgttattaagaggttaatgatagagttagatagagggatagatattgagagaaagagattaagaaagattaagatttatttaggatttaggattagttttagagagagatgaagataaaataaggtagttttttgtgagagatagagggtaggttttgagaaagagtaagtttttaaggttattttattttgtttgtgtaattttttttggtgtagaagagtgggtaggtttggggtgaagtttgattggaggtttgtttttatttttggttattattttaaggggtgaggttagtgttttagggaagtggggtttttttattatgtgttttttttatttttatttttttttttttttgggtttgggagagggggaaggaagtagatagggagataaggggtttagtttttatttttttatatattttttgaaaaattttttttaatagttttttggaattatattagtgaagttaattattataattattaggatatgatttagaaaaaaaaaatttgttttgttattataaatatttattttttttatttgggattgttgtttaagtaatggttgttttagagttttggggaaattgaggtgtggagatggggattggggtagtgtgagtaagttaggtggtagtttgattagtttgtagggttaagggtttagttttttttatatttgagggaggggggtatagggaaaatggggatagataaggttaatggtttttgtttttagatgaggatatgaggttttatggttaagggttttttgtttaaagttatatagttagaattggggttagaagtaggagttttgtaaatgatgtttttgttaagattttaaggtttaatataatttgaaaattttatgtttttaatattgtgtttatttttatagtatttgttatttttaatggaaattgtggaaggggtgttgtgtttttgtaggtgtgtgtgtttagggatagggaatttgagagattgtaggataatattatgtttaatagtaatattttggaattttatagagtttggttttagttttagttttgttttgaattagttgagtgattttgggtaaatgtttgatttttgtggatttgagtttttttatttgtttgatggagattataatagtattattttttgaggttgttttaaaaataaaatgagataatgtttggaaaataattgagtgtggtgtttggtttataggaatgtttttgtatgtggtggttggtattgtgatttatttttttttaggatattttttttttttgtttttatttttataggtgggttttttttttatgattaatttgtgtttggtggtgattgttatgtagtttttagagattaagtagtgggaaagttagttgatgtgggagtagtgtgtgtggtttttgtttaatgttagtattttggttagtttttttgagtttggtagttgttatgaggagttgtttaagtatttggtgtatattttttgtaaggtagtttgtaggttggtttaggttttttgggtagtaggtgtgtgggttgggttgtttagtagtttagtattttttgggggttaggagatttagtttagtagtagttgtttttgtttttattgttgtttatttgtttattatttggtgtattattattattattattattattattattatttgggtaatgggatgtttagggttttttgggttagtttggagatttaggatagggatgttaatgggttttgttggtttatgttgttattatttttgatgtttgttttttttggggttttttttggtggtgtagagtttgtgtatagtttttattatgttgattgttatttagagttagtttgttgttaggtgtttttttttaggtttttatttgaggtatttggtaggattgtgggtagtgggaaggtgtattttattgtgtatattagttttttattggagatgttgaaggagaaggtattagtagaggtggttgttagttttgggtttttaatttttattagttttaatattttatttgggttttatagttttatgtataagttgttggagatatagagtataggtgagaattttgggtggaggtatgtgggtgtttttgtttggggattgggtggtgttttagaggggattagggggtttggagttagagggattagggtttatatttttatgttgttttttatggtttaggtatttttaattagttatatttttgttatgagtttgaatttttttatttgttaaagtggaatttataatttttatattgtaatagtagtaattattatgtaataagtatttgttttgtgttgtttgtaatgatgtttagtaattgttgtatatagtaatggttgtgtgtttgttatatgttttgtgggtaaaattttattggattttttttatttattaagtgataggtttttttagtatttttattgtgtggatgagaattaggaggtttgaggggattgtatgatttgtttaaggttttgttattggtgaggggtggatttggggtttgtatttgggattttttgttgtgaggtttagagaggaaatggtgtgtgattgtgtttagttttatgttttattggttaaatttgagttttattgtttttgtatagggagatttagtttagggagttgtttgtttgatgggtgatatttttagtgttgtgggggtagtgagatatatagggatgttgggttttttttagtagataggtttattgtagttgtagtttatggtttgtgttttaggaaggatgtggtatgtggggagtagtgggatatttgtggggatgttatgtgggaatgtgggttgggattagaaggtgttattatagaatttagagtgaaaggtttttatgttagtttttttattattttgttatgggatgtgggttagttatatgtatttatgtttttatttttttttgtgtaaaaggtaaggttgggtttataattatttttagtgggtgtttattgatttttttttgtgtgtagatgtagttaagggagaaatgttgttgagagtttatttggggttaggttttgagtggggggtttttatatttatgttttatttggtattttttgaggtttttatattttgtgattaaagttggatttaaagggatattgatgttttgggttaggtttttgagtgtgtgtgtatgagtgtatttagtatgtgtgtatgtgtttatgtttatgaaggggtttagtgtgtgtgtgtgtgtgtgtgtatgtatgtgtttggtgtttatatgtatatgtgtgtatatgtgtttgatgtgtgtaggtgtatgtgtgatgtgaagttttttttttggtgtgtgtgtatgtgtgtatatgtttggtatatgtgttgtgtgtgaatgtgtttgtgtatatatgtgttggtatgtgtatgtatgtgtgtttatatggtggtgtttaaatagtatatatgtgtatatgagtgtgtgtatttggagtatgtgtgtaggtgtatgtgtttggtgtgggtgtgtgtgtaagtgtatgtgtgtgggtgtgttttaaggattttatggaaagtgttgtttagaatagtgttgatgtagttttggtttttgggaaggggaaggggagtgaggttttttgttgaaggtatttaggatataggagttgtttaggattttagaggatatttaggttatttttttgagttttaggatatttagtagtgattgttaatgaagtgttattgatattagggtattttgtgggttaagattgtttattttgtttgatatttagtatttttggtttattaagtgtttagtattttattattgtaataattttagattttttgatttattttatatatatttatagggtagggtagttttaggtatgagattttggagttttttatttttatttttttgttttaggtgtttgttaaagtttttgtaagatttttagtttttgtttgaaagtagatagtggagtttgtggtttagatagttgtttttattgtgtttgggttggggtaggggaggtggagtttgttgattgtgaaatgtttgatttagatagtgaggtagtttatgagtttatataggatgtttagtatagtgatttttgggatttttatagttggtggtaatggagtttgggtttagatgtagagtttagttttgtgttggttttttggaggttaatttgtgatattttttgaaagattgtggatagtaagtattttggttggggaattatgattgttattttggttaatatatttagtatgggtattgaatattatgagtaggtaggagagtgggtagaggtagggtttttgttagttgttttttgtttggggttggggttttttatttttttttgtatttttttttttgagtttagttttttttttatgttgttagtttatttggtaggtaggaggggaggtgggtgatggagtaatgtatggggattttttagagggagtgtttaaagtttttgagtatggaggttgttttaggtaggttatagggtatgttttatttaggaaggttgtttagaggaggttggttttgaaggatgtgaataagtggtgagtattagtatgtggggagaggtgtgttattgggagatgtttgggtttttggagaaggtgtagtgtggagggtgggtgttggaggttttgtggtatttatttgatttattaagtttgggtgtgattgattggaggtaggaggggttatgtaaataggggtgtagaggggagggttggtgtttgtgtttgggtggaatgaaggtttgttggggttagggagggaggtaattttttttggttttttgtttgggagttgtgttgtgaattagggtagtttagggtggatgagagtgtttagtatggtaaggggatttgaagttattgtgtttgaggaatgattttaagaattgggatgtttagttaggaggagtaagggtttagtagggataggtaagttgtttttaaatatttgaagggttgttatgtggaagaggaagtaggtttgttttgtggggttgatggttataagtaataggatttgggttgagggggaggaggtttttttaatttttagagttatgtagagatagaaagggtagtttgggggattttattgattttttattatgagttgaagatgtttgtttgttgggggtttaagtaggtattatgggtttttataattgggtttggtttttttttttatagggttttttttagaagttgttttttttttttttagtttggttttttaggttatttttgtggttgatttttggaaaaggagagaggttagtaagtaggtgttgtagtttatggtttttttaggttttgtttttttgggtgttttggtttttttggggtagtatggaggtattgggttattagaatttaattttttttggtttggaatgaaggttatgtatttttttatttttgtatttttttaattaggagtagaggtggagggggttagtggtgtggagtggtttttatattagtatagtattttgtgaaaggggtattttaaaaaggtggtataggtagggtggtataggtatgttgggaggtttgggttgaggttgaggggtataggttaagttgggtttggagtagatagtgaggtgtttatttttttgggggatttgaagtttgtttttatattattgatttttgtatttgtaatattttgagtatttagtttttatttaagattgtttgatttggttaggtgtatttttttttattattattatatattggtgtttttttttttaatttttatagggttttttttaagtagttatgaggtggagagagagtgggattttggttgtagtgttagtgggtgggtgtatttgatattatggtgggtatgttgtgtttgggttatgtgggtgtgggtgtgtgtgtatatgttaattttgttagttttttagggagaggtgttttattttgttagattggtggtagtggggggtgggtagtattttttgtttttgggatttaggtggtgatagtttttaattttttattatttaggttttttgaattttagtttttttttttttatttttgttttggttatggttaggtgttttttttttagggggtatttttttagtgttttttttttattttggggggagtatttagtagtttttgtttagttgatgttgttggtggaggttttgattgtattgggaagaagttgagttatatagatttagggtagatgaagttttggtaagagggtttttagttagatgttaagaaggatgtttttttggagagaaggtagtagttgttagttaggggtgtttgtattttttttttgtttaggtttttgaggaagggtggagatagtttagggtttttattaagtttttagtagtagggaggttttatttagtgatagtagtgtttgttttagggagggttttgtttgtatatttggtgttgagggttttatgggggtgagtgggagtttttagtaggttgggtagatgattgatagttgtttagtgggtttaggggtgtggagagtaagaagttttagaagttgttatggttttgtgtttgtaggtattgtggtgtgaatgttttgttatttgggttttggagtttgagtaggttgggagtggggggttgttagggaaggtagtaaggagatgtggggggttgagatagagatatagagtgggtatagagagggagatagagatatatgggggaatggggatatagagggagatagagaggagattgatgggggtgagatagaggtatggagggtaagatggagatgggggaggagggtaggaagagagatgtgtaggtaggggagaaaggatatggagggagagatgagttatagtggagatagatagagataaatggagttatagagatatatagggagatagagatatagagagggagttgaagatagagattgagttttagatgtaaatgagggtagagatggggtgggatggggagatagagatttttttggagttggttgtatgaggaggtttatggtttttttgtggtgtttttaatgaggtaattgtgtttattgattttggaattgattggatgggggggtgggtattggaaagggtgttgttggtgttttgttagaggaggagtttttgtttttttttttggttgttattgttgttttttttaggttttgtttttttttattattttttggttgatttattatttgtttgttttgtttttttaatttgtgttattttattatttttttgattgaggaagtatttatatgtgatattttattttgtttggggttggttttatgttgttttttgttttttgttttttttattttttaattattagttggaggagaattggtaggattgggtttgtttagagggttggtgagaaggataagaatttaggagattgaggagagagtaagaaaatgatttgatgttgaagtgtgatttgatatggggttagtttatatgtgtgttttatttgtttagggtggtatatggagtttagaatttttttttaatttatttttttgtattggagttgggtttaagtagtgatttgttggtaaatgattaataattagtttttttaaaataataaagttttgatttgtagtatttgttaatttttatggtgtaaatgtttttattatagttggttttaagttattaatatgattttattgaatgtggggttgggaagagatgtggataattggtttttttaagttagtgagaaatagttttagtatgttattgggtttaaggtattgtttttttttttaaagaggttataataagtaaatggttatatttatttgatgtggtatatgtttagagagggatatgtggaggaggagtttttaatttagattagagaaggaatttagggagggttttgtgtaggaggtgatttttgggttgagtttgaaggaagagtaggatatagttagtgaaggtgaagggtagggtatagtatgagggttttggtagtggtttaggtagtttatattatatttttatttttggaaatggagagtagagggttggggagagttggttggtagttggatttgtaggatttaattagttggaaatatgggttgagaggaggtagtaaggatgatttttaggtttttatttggggtgggagtaatgtggtttgagtagatgtgggttgggagatatgttgtatataaggtgtttgtgggttattttgattatatttagtaggttgttggagtttagaaaagaagttgtttttttttttgtgttttgtttggttttgtattggggttagatttttttaggaagaggggagtgtaggagtggggttttggagatataggagttttttaatattttttttttggttttgggttatggtggggtgggggataggtgttagtttaatgttttagaagagggataatagtatatggggagaggggagttatatgtagtttagtggttttttgggttgtagatggggagaggaaggggagggattagggtagatggttttgtaggttgagagaggatagggtaggtgatgattttgtttattgtttatattttggggttattttgttattttagatatatgtttagagagggtttttatttataagtgagtgagtttggttgtttaaggtgagagaagttgggggtggggtaggaggaggtggtttagatatggtaagtttgaattttgaaggaggttatagatttttttttagttttgttgaaggttggggattttttttttagaaaatttttatatgtttggatattttaaatgtggtttttgagggtaaaggttgatggatattttttattttagttagttttttggtttttagatagaggagttttggttgaagagttagggttgaggattaagtagagttttgggggatgattttttgtagttgattggttttagatatttaaaggttatttggtgtgggagggagaggggtattgttttggagatgtttgttaaggtgtttttttgtttttttaggtattttttggttttaggtttttttagttttgtaaataaggggagtatattttgtgtatagtatattagaatagaatattagaatattagggggttgggggttgagttagaaatatttaagaaatgtaggttttggtggaaaagttattttgttttatggatgattatgttaaatgttgtaagagaggttttaggggataaaggagagttgtttatttttagtttttttttggaagggttttatgaaggtggtggtttttgaatggagttttgaaagatgaatggaattgatagtggtttgggtggtgggggtggggggaggtgggagatggaggggtgggtaggagtagagagatttaggtggagggattaaggtatatgtatagggtggtatttgatgttttgaaggatagttaggtttttttttttgttttggttttgaggtgtttgagtagtgattgatgttagtttagtgaggaagttggtgttttttattggtgtaggttgggtggaggagggtttagaggttatttttgttgtttagattagaggtaaagagggttttaagtaaggttatagttatgggaatgaggggttgtgggtaggatgtaattttattggtaggttttttgggttggggtattttagtgtttagagggaggaagggtgggtaagaattttagataatttgaagtttttaaggtagaattttgagtatgatggtgttatttgggaaggagtaggtttgggagaggaggtgagagggtttgttttggatgtattgagtttgagatggttgtgggttattttaggagggagattaggtaggttttggatttttggatgagaagttaggggtttggagagattgtttagtgttgtttatattttagtgatagttagagaggtaggagtgggggtattggtggagggagtgggtttagattgaattttgaggaatgttggtttgagggaagagaggtggtgaaatgagtattgggaaggggaagaggtggttgtttagggttggggaagttaagggaggtttagttgttgttgaggtatttattaagaggagggttgggaagagggtttttggatagagttggagttgtggggtttagagtttagaattgaatgagtttggagttttatagaagttttttgtttttaggtatgggggaaggagattggagaagtaatggatgtaggtataattgataggttagggtttaggggagttgggggtgggggtagggggtgataggggggtggtgggggagtatattaaagaattaaagtgtaggtggaggaatggttggtttttttttaggagaggaagagagatagtgggatgtataatatagagttttttggaggagggatgtggagttttttatgtaagtttgtaatgaggggttaggtggggagtagggttgggggttgtagagtttagaaggattgaggtagtttttgggggagagaggagatttaagaagggaggaattagggattgtgaataaaggtatgaaatagttatggggttattatttatagggaattatttgtttagttagtatatgtttgtgtttttttttagtgatatttagtatttttagagttgtagaggagaggaggagggtaagggtatttatttgggttggggttgggtagggtaggagtttttgaaagtttttgttagaagggtagtttttatgtggtttattgtggtttattatgggttagatgttgtgtaggtggataaggtataggggttgtagttttagtattttattatttatttattttaagagatggaattttgatttgttttttgggttggaatatagtggtttgattatggtttattatagtttggaatttttgggtttaagtgatttttttattttagtttttttagtagttgggattatgggtatttgttattatgtttggttatagttttagaattttaagtagtaggggttttgggttagttgttttgaagttgagtgggtattgtgagtgtgttgtgtttagttagtttgtgtgtttatttttgagggttttggggagttgggaaatattatgttatttatattttaatgatagtggagaggtgggagtgggggtgttggtggggggaataagtgtagaatgaattttgaggaatgttgttttgagggtagagaggtagtgattgtggttaaagtttttttttggtattgtttttgattaggaggttttgggggtattatgatatttagtagtgtgtttagtgggtaggagggtataggaggggggatttaaattggagagtttttgggggttggggaagattaggattatgatttatatgatgaggtttgtgagatttttaggaaattttttgttattgaggtgttttttgattttttatatttttttgaagatttgttttttattgatttagtgatttttattgttttattgtagtttgtttgtgtttttgttttgggtgggtgggagtagtaggtaggtttattagaagtagaggtgaggtgagttgaggagtttgaatagaagagtagagattttagggttagtggagtaggtggaagttggggtgatggtagttggttggggttgggtttgggtagagtatgagtgattggtttaagtttttgtttagttttgatgaggtttgtttagttttttatgttttttttgtaagaggtatattattgtttgttagagttggtttttaggttttttgtttggattgttgtagtattttaattggtttttgtttttattttttaagttgtttatatgttgttattattgtagttagattaattttttttatatattgttttgtatattttttttttttttttttatttgtttttagggttttagtggtagtgtggtaggtagagatttgtttagagggagtagaggaaggttgttttatttggttttgttgattttgtagtttttttttttattagttttttttattttttgatttgggtagataatttgatttttggttttgtattgtgttttgtatatttttttttttgttgtttttagttggggatattttttatggatatttttttaggttgttttttttattggtttattgattttagttgggattgagtttttgtggtttttgggttttgtttttagtgtggtgtttagttgtagttttgtagatattggttttgttttttgtgagtttggttttggggttggggttttttatagttttttatttttttgttttgtagagtagttttttaggaggtagtgttattttgtttaatagaagaggttattggggatttgagaggtaaagggaattgtttaaggttatataggaagaaagttttagagttggtggtatttttttaatattagtgtttggtatatagaaggtatttttagggttagttgatggagtagttatgaggtttggggagttttggtgttgggaagtattgagtagtttaatgttgttgtaaggtgatagttggaggggaggggagtggaggtgttaggaaatgggagatggagatttatagttaatattagtatagataagagatttgggatttttgggtgggataagtttaggttgtttggttttattttattgaaatttttattgggttttgatatttgtgaatagtaggaaggatgtaggttagatttgggaagggatttttatagttgggggtggttagtgaggggtggttggttttagtttgatgagtttgtgtgttttttgtgtgagttttgtttgggtatatggtgggggtgatgttgtggaaaaggttttgagggtagagatgtagagggaggtataatggatttggttttgtatttttttaggagggtgatgtgatttttattaaggtattatattttttggagttttagttttttagattatttaggaggtttatagtttttttttgtttgttgtgagtagggaggaaatgaaattttatgaggaggtttttagtttagttggtttgtggtgggtattgttagatgttggttttatttttgtttttttttagttgtaattatagttttggtttttggggtaattttgttgttaagattgtgtttttatgtttttgttttgtatttgtagattgtttttagtttttaatttagtaatttggatagatttggttatttgggggaggagggttttttttttatggtttattggagggaatattggggttttggagaagaagtggtatttattttaagtgttgtagggagattagagagagtaaggtagggttgagggagtgtgttaggtttttttttatttgtattaggttgttttgtttttttaggtttggagttatttggttgggtaaaataggggttttagtttttgttggtatagtttttgataaagtttaatgaggtaagttttatgggatggtaggttttttaggagtttggtattatttttttttataagttttttggtggtgtgtaggagagtgaggtgtgtatgtgtttataagttattagtatagatttttgagagttttgtggataatattggggagtgaagagaatagtttttttttttatgtatagtagtagttggatttttagaatttattgattgagtaaatatatgatattaaaagttattgtgtttttagtaatttttaaaagaatgttttattaatttttatttttagtagttttttgggggtatagtttatatgttatgaaatttgtttattataagtgtattttagttgtgtttttatattgagttggtttttatttttagaattttgttgatttgaatataattttagaagatatgttgtgtatttagtttattgtgtatttggatttataagttttttattattattgtggtttggttttgaattttgattgtttaatatttttggagttagagggatgtgggattgggttttattttagttttttttgttttgtgattttgaatattatatttgtgtggtttatgtttattttaatttaatttaaggtttgaaaatatggtgagtggtagagtgatagggaggagggtttgttgatttttgttttttggtagattggatttggaagtatagagtggggggatttatttagttaggtggggtttgagtttagggttttatatgtattgattttggttttgttttattttttgtattgtgtttatgttggagatattaatggttttgtgtgattgggttaattaggttaggtggtagtgtttttatttataatttatggagttatgatttatttgagatttgttggagtaatgggttttatgttatattggtttttatgatagttattttttttttgtatagttggttgtttgtttgtttgttggttttgattttgtttttaggtttgtttttgaatagtttgaaagtttatttttttttgagtaattgttgtttttgaggtttttaaatgttgtttatttgttagttagaagttttttgttttgagtttttttattttttatttaagttggttgtataaattagggttattaggatatatttgggtgtttttaggtttggttgtaggtttggttgggtagttggttagtgagatagtgagaagtaaggagaggtgtttgatggaatgagtgttttatttgaatgttttattaatttatattttttgagtagttattatggatttggtttttgttttttaggttagatatttagtttgtttagatatttattaggtggatagtggggtttattgagttaattatatttttttttgtttttttagttttttgtttggttatattttttttttttttaattagaattaggttgaggttgtttatgatttttttattttgtgttatattatttagatttttggttggggagattttataaatttttaggtatttaagtgttgttttttttttaattaagtttttttttgtgtgtttattttttatttttttttttttgaatttttggatttgttgtttggataatttattttggtattgaagtatttaaggttttttgtggttatttagttgttttgtgtgtgtataatgtgtttttagtagatattgagtttttgggaggtggggtgtgtggttggtatgtttttgtagtttttttaatgtttggtgtattgttaggtattttatattgaaagtgaggttattagtgagttggaatggtagatgagatagggtttgttatttgtttttttgaggattttagggtgtatttttagttttagttttagatttgggtagggagtatgaaaggaattatttttggtgttttatatttggttagagaggttgagaattttgttgaaggttatagagtgagtgataggataggttgaggattaatttgggtgttttgggtttaggttgaggttttaggtgtttttttaattgtgataattttttttgggtgtttgtgtgttttttttttgtttattattatgtgtgtgattgggaatgtgtgtatttttttttttttttttttttttgtgtgtgtgtgtgtgtgtgtgtgtgtgtgtgtgtgtttggaaggaagtaagagtagttaattgttgtttaagagaaagttgttaagtttatagagtaattgtggaatatatgtgatgttgtgtggggtttgatgattgggtgtgtttgtgaggttttggtgattgttttttgatatttgttagtattgttatgttgttggtttgggtttgttaggtttgtattgtagtttaggttaagatgggttatgtagtttttagtaggagatagggtggaatttatattataggttttttattgagtttgtggtttttgaatttgagatttagagttggggttatgggttttatgtggtttttttttggggtttttgtttttgggtgtatttttttttggagtttttggggtagggttttttttatgggtttgagtatttagtaatttttttgtataagtttgttatttttgttttttttttttttggtgttttatgtttggaggattggattgaggggtttagtgataagttagttgttttatattttattttgttttgtagtttgaggagtttattaatgttttagaaattagtaatattgtttttattagtttttttgttttggagatgttgttgaagttgtttgtgtatggtttttttggttatattaagaatttttataatatttttgatggtgttattgtggttattaggtatgattattttttggtattgatttttagttgaggaatggtagtaggggtggtttggggttaggggttatgttatttatttttttggggtggaggggtttggagttaggttttattgattttataggatttgttattttttttaggtggggggttttttgtgtttttatgttttttttattttttttttggttttattttgtttttgttgattttgggtttatttttttattgtttaggtttttttttagttttttttttttatttttattttttgtttttgattttatttaggtttgggatgggtgagggtgagattggttttagaggagttggaagaggtatgaggtttagttagttgtttggtttgaaaagtgtttggaaattattttagatattagtaatttgttttagggtttttaagattttgggaaagtgttttgtttttgtaaggtttggggttaggagaattattttattgtttttggaattggttttagattttattagaagagaataaagtaaatattttataatttgatgtagttgtattggttagatttagggagggagttgtttattgttaggatgtgatttttggtagggaggagagggtggagggggttggggttgttatttaaatttttattattttggaggtttttgtttagaggtttgggggtttatttgtgttttatttttttttgatgtgtttatttagttaggtttttgggtgttattgagttttttttgagggagtagggggagagggtgaaggtgtagggggtttaggttgtttgttttttttgtagtgtgtgggagattgtgggttagtaggggggtggtttgttggtgttgtggattttttgtttgatgtgtgtgttgaagttggtgtgttttttgttggtgttgtagtggtagttggtggtgtttatgaagattatggataatgtggttattttttgtatgttgtttatgttttttatttttatttttaggtgagggtggtatggtattttgttggttgagagattggttaggttgggggtaggagggtttgaggggtgaggagtattgggttttgatttttagtttgtggtttttttgtgtttatagtattttgggtatgtatttttttggttgtaagtttgtttttgagtgggatggggatattttgttagattggaagaattttgattttttgttttgggttattgttattgttttttaggtgtgagggtaatagggtagggtgtggataggggttgttaggtgtttttagtataggttttgatttttgttttttgtttgtagattttgatttaggaggattggaataaagttttttataatggtatggtttttatgttgttttgggtggttttttattttattgtttttatgatttttggtaattatgtgttttttaatttgttggttgttattttggtggagggtttttaggtggaggtaatttattgttttgtttattttattttgtttatagtagttttatttttaattggttgtttgttttgagttttttttttttgttgttaattttgggggtttgggaagttttataggaagagttttttagattaagttggggtggattagggtgggaggttttagattttgtgtagttttttattatatgggatatagggtggttgtttggggtttttttattaaagtttagttattgagtagatattttttttagagttggttagattttttttttagagaggtagattagataagtgtttgtttgtggtgtagttggatttttgagtatagtgttttatggaatatttggagaggatttttttgagttgaggggtgtaggaggtttgtgtgtaagttatttgagttttgattgagtagatgaagatgttattaagattagagtagggttgagttgtttagggtgagaaatgagtttaattagttatgggtatggtagagatgagtgttttatttttagtttaggttttattatttttgttataggtagtgttattaattaatattgatttatattgattttgtttttgttatgttagtgagtagtttttgtttagagggttgtattttttttttttttttagttttgtttttttttttatttgagtttttagatttattttagtttgttggggttttaaatagggtagtttgatttaatttagaaatgttttaggttgggtttggagaagtttttggtttagttttttttgggtgatttggatggaaatttttgttgtggtttggtttataaatatttggtatatggtggaaaaataaaaatttattttttgatttttttttagttttttaagggagggtttttttttgtgggttggttgggttggtggggtgtagtgtatttgttttatattggtttttttttttgttattttttttagtttgtagttatttgttattgtatttttttttttttgtggggtagttagggtagttggtgggggaggttttggtgatggttgtgttttttgtagggaaggagggagggatgttggtatgttttttggaatgggatattaatttgggggttttttgaggtttgaagaattaaggggtattatagtatttttataagagttagtagatttattttgttgttgtttagggtttataagaggaggagttgagtgaggattgggttttttggttttttttgaaggtagtttttgttagttatggtttttttagaaaaatttttgtgtaattttgtggagggaaatggaaaatattgtgggtttatttttttttttttttttgttatttagttgttaaggtagtttggaggtgtttagtatagatggttttttttttagtatttagtttttttagtaaatattttgttaatttgagtgtagttgagtggtttggttgttaggtaatagtaaagttagagtgtgggaatgagtgtagtttggttttggggtggtttggttattttggttttgttgggggtttgggattgttttagtgtgagggtttaataaggtttatgtagttatattttttttaatttttgtagtattaggatttttgtagggagggttttatttaggatgtggtgttttgggttgggatgttttaggtttggggtgggatggagaaaggattttaagaatattttttttttatgggagtgggtagtgattgtggttttggagtgtttatgggaggggttgggttagttgtttttttgttttgtatgtggtgggtagggttggggagtgttttttgatgtttatggtttggataattttaaggtatttgtttttttttgggtaaggttttagggggttttatggtttggtaggggagtttggttttgttgttgtggtggtttgggatttttgtttttattttgataaataagataatttattttggtagaggaagtggttgtttttattttggtgggtttttttagtaggaggttttaagggtagtttttttgttggttttgttattttgttaagagttaggagggggtggtttagggatatagtttgtttggttggtgattttttgatttgtagggggtagtgttttgaatttttgtgtatttattatttatatatttaattaaatgaataggtagtaggttttgtgtgaggttattaattgatattaaataatattagagttattattttagtattatttgttatattttattttaaatggagtagttggatttgttttgatttgaagggatttaagttgagagtatgagatgttatgaggtttgatttggttttgtgttgattttgatttttgtttatttttttttttgttttttatttattttttaagtttattgtttttgaattggtgagaggagagtggtgttttgagttatagatttgggttttaggtttagatttattttttattttgtatgatttggggtagtttttgtaatttttttaaattttgggttttttttgtgtaagatggtgattttggaatttattttttattttgtaaggaagttagttggtgttaaggaggtagttttttatgttaggtatatttttaatgaatggtggttgttattattaggattatggggggatttgtttttgtttttatttttttggtttttgtatttattttttagatttattttggtttgagggtttgtagttgaattttggaaggttgttttgttttttttttgtttttttattttttgtgttttttagtttttttgttgtggggtttgtgtttttttttttttttatttttttttgatattgttgatatttgaaggttttgagtgtttgtgattagtagtttttttttgtttttttttttttttgtaggaaattagtaaatgggaagatgtgagtggatagttaagttgtatttagttgtttgttgatttttagggggtaggtatgtgattatgagttggtatgttttttgtgttttatgtttgtgtttttttattttgtttttgtgtttttgtgtttgtgtttatgttttgttgttgtgtaatttgttatagttgtgatggttattggtgttgtgaggtttgttttgattttaagtttttttttttttgaggatatggaagggaggtatttttttgtttttgtttttattaatttattaagggtattatttttatttttgttagattggtggatgggttggagaaggaagggatttagaattttttgtgtgtatgtgtgtggggtattttgtgtgtgtgtgtttgtgttgaggttttggaggagttttagatgtttggttttagtggagttaagatttggttgtagattatatttttttattttttatttttttattttttgttttaggtttttgttggagattttgtaagttgttttagtttaggataagtttttggaggatgtggggatgggatgtggtttttgttaaaatgtattaatattttaaattatttttgagtttttggtttttttattatttatttgggtttggttggtgttgttagggttggtttttggtttggttttatgatgagtttgtgttttgttgttttttgttttagtattagaatttggggtgaagttagtatttttgtgggattttatggtgttgtatattttgagtagttttttggagattttatttgataattaaaggttttgttagggttgtaaattgagttaatgaaaatgattttttgagatgttaattatttaatatttatgtttttattaaaagtagtaattaagtattttttaataattttttaaggagaagtatgtaattattggggaatttattgatttgttaagaagaaagaaaaaattgttttagagatagggagagaggtaaaaatggggttagggagggggttgggatttggggaagatgaagggaagatattgagggattgaagtggtgtttttgggttgagttgttttgtttggggttttttaatttttttttagggtttttgagtttgaggtttaggggaggggagttgtggagagaaagtaaagggtttttagtgaatttttgtaagagaggttttagtgattattttatttaggtttttaggtttttagttttttttggtttgtgttatttgttatttagttattttttttttttttagttagttttggtgattgtttagttaggttggttgtgttgtgggtttatataagttgtggttttttttgaggtgtggttggagaggtagaggtggtggggttttgggaagttttgggttttaagtttggggggtttggtttgtgttgtgtatgttttgtgttgtggttgttggtttttgtggtttatatgtggtgtgtgtgtgtgaagagagggaggtttggtttattttaattatttaagtttggttggatttttaatggtttgttgtttttttgttttagggagatgttaataagtttgaattagagtttgatttttttttatttagtttggatggtgatggggataggaagaagtgtttggtttgtgagtatttattttggggtgtgatttttggttttgggttagttttgtgtggatttgggatttttttttttttttttgtgtagtggtgtttttgggagagtatttggagttgtggaagagtttgttgttgttttttattatttatatggttgttatatttatgttgttgtttaagagtattagtatgggtttgggtgaggtgttgggttttgtgttgtgttgtattagtagtagtgggttggtagagtttggggtggtttatgagatgaagttattggtagggggtgtatgtgggtattttgatggtgggagatattttaaggaggataggaggaagagaggatggaggtaggtgggtttaagggtatagtttttgttttatgggttggatggggtttgggtgtgtttggataagtttttggggaatttgtgttggtgatgtaaattagggtaggagttttagtttgggggttgaaaatagggtttaagttgattttttttgtattttagttgagtgattttgggtaagatgttattgttttgatttgtttttgtaaaatggaggtggggtgtttatatttttttaagattgaataataataatagtagatttttatttaggtattgattttgtgttagatattgttttaaatattattttgaagtattttaaatgtatttaatttttatattaattttgggaggtaggtattataatgatttttattttatagagggggtttgagttttagattgtagaagggaatggtagagttagtattttaatttaggaggttagtgttggtgtttatgtttttatgattttatttatttttaatttttttaaattttgtttttaattgataaatattaattgtgtatatttatggggtataatgtgatgttttgatatatgtatatattatgggatgattatattaagttaattagtatatgtattattttatatatttattttttttgtggtatgaatatttaaaaatttatttttagtaattttgaaataaatatgtattatgttattattgattatagttattatgttgtgtaataaattttgaaaattgattttttttgtttaattgaaattttgtattttttggttaagttttttttattggttttatttttattttttttaattttagtttttgttaattattattttattttttatttttatgagtttaatttttttggattttatatataagtgagattatatggtatttatttgtttttttgtgttttgtgtattttatttagtataatattttttagtttatttatgttattataaatgatagtttttttttttaaggttgaatattattttatagtgtatgtatgttatattttttttttttttttttttttttttttttttgttttgttgtttaggttggagtgtagtggtatgattttaatttattgtatgtaatttttgttttttaggtttgagtgatttttttgttttagttatttgattagttgagattataggtatgtgttattatgtttggttaattttttgtatttttagtagagatgaggttttattatgttggttaggttggttttaaatatttggttttaagtgatttatttgttttggttttttaaagtgttgggattataggtatgagttattgtatttggtttatattttttttatttagttatttattgatggatattaggttgattttatatattggttattgtgaataatgttgaaatgaagatgggaatgtttgtattttgtttatatattgattttaaattttttggataaatatttagtgttggaattgttgggttatatggtaattttatttttaggtttttgaggaatttgtatattgttttttataatggttgtattaatttatatttttattaataggatataagggtttttttttttttagatttttattagtgtttgttattttttattatttttataatagttaatttaataggtgtgagataatttattgtggttttaatttgtatttttttggtgattagtgatgttgagtatttttttatgtatttgttggttatttgtgtttttttttttttgagatggagttttattttgttatttaggttggagtgtaatagtttattgtaatttttattttttaggtttaagtgattgttttgttttagttttttgagtagttgggattataggtgtgagttattatgtttaattaattttttttatttttagtagagatggggttttattatattggttaggttggttttgagtttttggttttaggtgatttgtttgttttggttttttaatgtgttgggattataggtgtgagttattgtgtttagttttgtgtttttttttgaggaatgtttatttaggttttttgtttattttttagattgggttgattttttgttgttgagttgtgtttttttattttattatatatattgttatttagttgatgataatattttttttattaaataaatgaggaatgagttttattgttatatttagtttatagatgaggaaatagatgtatagagaggtttaataatttgttttaggttatatagttggttggggtgagttaggatttgaatttaggtattagagtttagagtttttgtttatatttttatatttgatgtgatgttagtgaggtttttaggagattgggtgtatatgagaggatagggttgttgggttttgtttgagattattttttttttgtttatttatagtttagtgtttgtagttttttgtatagtttttggagtgttgtaagtagttggattagtaggtgttttagttggaatagttttggttgtgtatttagtttgaagtggagaagtttaagtggagagtggtggtttttgttgttgggagaaggttaggagagttaggatgaagaggagagtttagaagaggagtgggttagttttgtgggtagtgattattgttatagggggtttttggagtgggaggttaagagtttttttgatttgttagatatattgtaggtgttagggttgtattgtattgttagtggttgagggtttgtttttgagtattaggattgtaatggtaagttggttttagggtgtttggtttgggttttgtggtttgatgattttttattggatggggatgatgttgatgatgagggtaatttggtgaggtttttgtgggtatagtgattttttatttttgattttgaaagaggggaggtgtgtttggtttggtagggtataagggagttattattttaagtttatggaatattaaggggtatttagaaattgagttttaaataattttttttttttttttgtttgttttgttaagttttagatttttgttatgtttatgtttggggttgtggttttgttatttttggtggatatgaatgattttggatagatgtgtatgaattttttatggttttttttttgtgatttagaaagatttattatttatttttttaaattgatgttttgtattttttttttttgttttaattttattataagttatgattttttattttatttatatttatgtgtttttgttttagttttttattattattattttttttggggatggggtgtagtgattttagggttagtatgtgaagagtagggttagtgtttttttagttgaggtgtgtttttgaatagatagttgtgtggggttagtgtttgataattgatgttgttttttagtttagtagggaggataggtagggggttgggttggaggtaggggtggggagaggggagagtggggttggggatgtaggggaggagagggaggaggtggagaggtaaggggtttttagggatggggagggggtttggtaaggttgatagggagatgaggaggtggttttaggaataaaggaagagaggtagggtagagtttgggttttaggtgggagagggtagataaggagtgaggtttgtgattttgttgaggagttaggagttggggaatttggaggtttggttttgtttatattttagtgtttgttttgtagagtaaaggggaatgggtttgtgtgtggatttgagtttgattttttgtttgttgttttgagtgagatttttggttagtttatattttttttttttagtttaggtaagtgatagggtaggggtttgatttgtgttttgattttttttttttatgggaaattattgttggtgatgttgttagggatttgagaagtggtattttgtttggggtgtgagtagggtggttttagttgggagggtattggaggggtaggggttgtgggtggtgttttttgttgttatttgttttgttttttttttttagttgttgtttttatgtttgggtaggttttgttttttgtgttattggattattatttataagatgtttgattatgtggtttttgttattattttttttaattgtattattattgttatggagtgttttaaaattgatttttatagtgttgtgagttattagttttgtttagggtaaggttttttttggggtttgtatttaggattagtgagggaggtaaggaggttatagttgttgatttgtaagttatatagtagggaatgagggggttaggatttttttttaggttttttattagattttggtttttgggatgttttttgtgtttttttttgttttagttttttttttatgatatattagtttagttgggtgttttgttttattttaggttattttttatgagttagagttttgtggggtatatgtgtgagttggggagtgttggggtggtgtaggggttgtgtgtagatggggaggtattttgtttagtttgttttagggttttgggggtatgtagagtggttatggaagttgttttttgtttttggttatttttttaggttaaaattaagtagatttttaggggttatagtggggatatgggttatttttgtttggttgtgaatttgttagttttttttagaaggagagttagaggttttggatatattgttttagggttgaatttttttagggtgggtttagtttattttgggagttgtttttttttagtttggtattatagttttttgttgttggtagtaattttggttttagaaggatgggtggggggtggttgtgtttttgtttatggtattttgtattatttgtttagaggtggttagggtttgttttttatttttttttgttattttttatattattgtttagattttagtgttgttggggtttttgttttttattagggttggggtggagggagtttgaggaatggtgggagtagtttaagattaggtgggtgagagagtatttgtattggggattttatatttggagttatagggtaaggtaggggtgttggttgtattttagttttggttgttttttgtttgaggttttgttgtagagttttttgttattatgttattgtttttatgttttttttattatttttttatttagtttttttatttttagttttgttattgtatttgttttttttttttttttttttttgtgtttatattttgtttgttatttttttagagatttgtgtttgttttttggttatttagggagggatttagtttatagatgttagggaattagatggtttttttttttgttttgttttagtttgtgtttgggggtgtagagtttgtgttaggattttagtttttattgttgttttatttttggggtgtatagtaggaaagtaagtgaagagggtgggatggtaggtaagggttagagattaagtgagattttgttttagtttttaaaaggaattagggaatagggtttaggatgtgggatgtagattatagtattgtagtgtagatttttttttttttgggttaagtggttgtgggggtggggagttttggttatagataggggtgtgattgtttatagagttgtaggggagttagggggtttggtattggttttgtgtgtgtatgagaggggtgtgatttatattgttgtggagggtgggggttgttttttgagttaaatgttagaagtaggttttgatttgtgtatgtagagtagatttggtttaagggtgggggttttttggtgggtaatttttgtttttttttttttgtaggaatgtatttttttgattttttttaattatatttttattgtagtttttttggttgaaatgatagtgaaggtgatgggggttggtgttggtttgggatttttggtttttggtgggggtggagatagtttgggttgagggtgggagggttggttgtagtgtagggagggtggttgatgatgtggtggtggtttttaggtggtggtattgggttggtgttttggggagtaggtgtatttgtggagtagttggaatgtgttggatgggttgttggtgtttatttttgttattgatattttggtgtttatggtttttgatagtggtattaagattttgggtatgttgagggtgttgtggttgttgtggattttgtgtttgtttaggtgattttttttttagtattggaatatttttaagaggtggttttttttgtagggatattttttattgttagtattttttgttatgaaataaaagtttgtataggttagtattttgtttgtgatttttataggtgattttgtttttgttttagataatatttagattatggttgtagtaatttttttttaggtgtatatttgttttttttttttttaatatgatatattttttagggttgttgtattatgtgatgtaaggtgattgtagttttgtgtagtatatagtataaggggttatgagtaggatttttatagtttttagttgtggtttttttttgtgtggtttttaggggtgatatttagtttttttttgtgaggtgataggttttttttgttggttttttttatttttaggtgtttgttagtgattattttttggtgatattttttttgattagggatttatttttttaggaatttttttttaattagttagttattatttttaatttagattttttttttttaatagggatgatgtggattaatggtgatgtttttttgattgtgatagtttatttttttttgtttttttttttttttgtttgtttttttataagtttattttttggtgtttttaatttataatatattgtatttttagggaatgttttatttgagttgaattttttttatttttaatttaaataggttgtatatttgatattttgggatggaggtggagatgtggggtatggggatttttgttatttgttttgagagattataataggggttttgatggtaggggttttatgaaaagaggatttgtgttttgttattagaggttaggaagggattagtggttaaggttgggggtggggagtagggttaagggataagggagggtttgggttgggggaagttttattattttttttttttttttttttagggtgattagttgggtgtaggggttgaagttggtggtggagatgttgatgtttttattgaaatttattggtaatattgtagttatttgttgtgttttttttattatttttggtattttgggggtgtaggtgtgtggggttttgggggttagttgtgggtgaaagtttgaagagggtttttttttttggtttttgggttttatggtttaagttgttgttgttgtttttattttagaaaggaataagtagggatgtttttttttaggttttaggtttttttattttttgggtattttaaagaaaagtgggagtttagaggaaggttttaaggaggattggggttgttgagaggttttaggttatgggagttgtaggttgttgtttttgttttttgtatgtattttttgagtatagatgttggtttgtggtttattttgggattttttttttttttttttggtttgagtatagtgggttgtaggttaggtttggggatttagggtttagatagttgggttaggttagtagtgtgttggtaggtaggtgggtgtagattttagatgaggtaggaagtgggggttgttggggaaatttggttttgggtttagggaggagatttggttttggaagagaaagagttagagttgtttgtaggatttagtagatgttttagggggttggggagtttttttattatagttttttagggtttttggttttagttgttttagttgtagggtagatagttggttgtttaggtagtgtgggagtttttgggtggttatatttttttttttttgttttttgtttttttggttttttgggatgtttattttgttttgggttgggggttgttttttgattttttagaaattttttagttttagggaataggttggggtgtatttattaaagttgtgtggtgtttttttgtatattttttttatttttatttagtgtttttttttttttttattttttagtttttttgggttagtagagtgaagtattgttgagtttagtttttttggtggatttaggtttgttttgagtagtttgtttaggttttttggttttgttttttgttttttattagtggttatagtttggtttataatggaatgagggtgagttttttaattagatagatttgggtttgagttttttttttgttatttgttggttatgggattttagtgagtggattaatttttttgagtttttgttgtttttatttgtaaagtggggttgatgatatttatttttttatttagagttgttgtgagaattaaatgtttagtttagtggtttttaaatttgagtttgtgttagaattattagaatggtttgttaaaagattgttgtttttttattttagagtgtatgatttagtagatttgggttggatttgagaagatgtgtttttagtatgtttttagatgatgttggggatttttatttggtatatgtttggtttaattgttggtggaagatgaatgattgttatttgtttttatttttttttattgtttgttttgattattttttttttttatttttggaaaggaagggggtgttggtaggggagatttttgttagtgtttttttgatttgattggttttagagtagagtattttatatttatttaaaatgtgtttaggttggtgtgggggtggggtttaggagttttgggttttttgtggttatagtttatttttttttgtttttgggaatgtgtgtttagttttttaaagggaagttttttgtgtgttagggtgaggatattaggaatattattaataaattggattgtgttgaggttagttattggtgggtttggtataagtataattttgataattttggttaggtgagttttaggtttagaggtggggttgtggtgaaggaggttggagggggtatagggttatgtttagtgatatttgttgattttggtggaggtgggttttatgaagagattagttttttatattttttgttgtttaattattagtatgttgtaaagtttagtttattttatagtgttttaaaaagtgggtttatggggtttttagttgtttttaaagatgaagaaatagaggtttagagagggtaaggggtttgtttagggttatagagttatatggtggagtaggaagtatatgtggtagtgggggtaggtagttttggatgtgaattttgtgtaaattttgattttattattgttagtttaatgatttggagtagttgatttattagggttttagttttattaattggtgaatggagttataatagaatttttttggaggttataataaggatgtaatgagatgatgtgtatatttttttaatatggtggaagggatggatatattgttaagataatttttttttttattttatatttgtagaaatagaaatgtagaaaatgaaattgtttgtttagttttgatttttagatttattttggttttggtttttggatttttagggtttttgtgtttttttttttatttggtggagggtagagggtgtgattattttttagggtttttttagttgtagtttagttatggaattttgagagggagggtttttttggagtttggagtgtgattttagtttgattttttaagggttggggtatttggagttgatgtaggaggtattttgggggtaggtgataggtgatttagttatatattttagattttaaatgtttttttttttttttttttattaggttttgatgtttttgtttgttttggtttttaaggatggttgggtggatattatgtatgatgggttggatgttgtgggtgtggattagtaggtagggttgaggtgggtaggatttatttgtgggtttaggttatttagtatgggttgattttaggatagaaagagtaaggtagggtggtaaaatgttatgaaagaagtattatattttatagtagaggttgttgttggtagtttgtgggttaaatttgggtatgttttattggtttataatatgtttaatatgttttgaattagtgatgaatatttttaaattggtgaatttgggttgtgtgtagtggtttatatttgtaatgttagtgtattgggaggtttaggtaagaggattatttgaggttaggagttggagattagtttgggtattatagtaagatttttagttttataaaaaataaaaataattagttgggtgtggtggtattatttggagttttagttgaggtgggaggattttttgagtttaggagtttgaggttgtaataagttgtgattgtattattgtattttagtttaagtaatagaataagattttgtttttaaaaaaagaaaaaataatggtgagttttatatagaaatttagatttgtgtttatttaggaaaagtttgaagatttgggaagattgggtttgtatttttttaaggtaggagttagttagaataaagaggtagttttggatggagaatttatttttttttttattatagtttttgtttttttttattgttttatattaaatttatattatttatttttattgtttgttaggtggttgtagttatttgggtttgtaggaatttaggttgtgggtagtttttaagatagtttgtttttgggttgatgtttttgtttgttttttttgttttttgttagtttattatgaattataatttttggatgttgttgtattttattttgtttttgtttattgtggttttttttgttttgaatatgtttgtgggtgtggtggtggagaatttttataagtgttggtagtattaggaggaagaggaggtttggtggtgggaggagaagtgtttatgaagattggagaaaaagagaaggagtaaggagaagtagatggttggttggtagtttttttatttttttttgggttgtgtttgattttggttttgtgattgtagggggttgggtgttggggttgggggtagggagaagaggtttttatttttttttttatttttttttttttaagagtatgtttgtttttagagtgagtatgaagtagattattttagttttatgggtagggggagttgtttttattttggggttttttaggattttagtattattttttttagatgatgttaaatggaggttgatatttagtttttttgagtttgatttttagaggagttttattggttgttttattgttttatgttagtatttagaggtttagggtgggtagtaagtattttaattttgtatttatttagtgtttgtagttgttgagtaaagttttagtagattttagtaatggataatagtgtaaaagagaatttagatatttttttttttttatttttaataaaattttttattatgatatatatatatatatatatatatttttgttaaatttaaaaaaagaaaaagtaaaaataaaaataaaaaaagaaaattttttttggtttggggaagttttggaataatttggggttttggagttttttatttttttatttgtgttttttagtattttttggtattgggtgggtgaagtttttatttgtttgtttttatgtttttatgttatgggtgggttgagattaagtgagaagatagaggttaggaaggatgtgagagatatagtaggtgtttaggtttttttgtttttggggtatttttagatgtgtttgtatttgttttttttttttttgggttttagggtttttatttgtttggtatagtgtaatttttgtgttttttttttttttttagttatggtttatgtttttttaagtgtttttgtgtgtgggtttatttaagtttttgtgtgtttgtttgtgtgtttttttttgtttggggtgagggttttttatgttttttttatttttttataaattgttttttttttgttgataagatgggtgtggtggtttgagtttttttttggtgtgtttatatgtgagtattattaaatgagtgaggggttgttgtgtttttgttttttttttgtttttagttttattttttttggtttgggagtggtattttgaggtggggggagagtgtgggagttgtagatgagggtggaggtgggagggggtttgtgttttttgtgaagagtgggagttgttttaggatgtgggggagatattggtttttgggtagtaatgggaggtgttgttttttatgtttttaatttttattattagtatttttaaggttttttgtttggtttagggtaggggtttgggtttggtttttttgtggatatttgtagttgagtaggtgtagtgttttttgtggttattgttttatttttgttttattttttttatttttattttatagttaggtagatggaatttttttggtaggtggtatttgtggtttttgtttgtttagttggttttttttttggggtttgtagttgttttaggtgtagttgaggttataatgtaggagaagtggatatttgttttgatgattggttgtttgttttttttggtgtttttttgttttgtgattttgattagttagttatattgtttgttttttttaagtgttttgtgtttttagttttgggttggatatttagagttagttatttaatgggtttagtgtattttatttataggtagagtgaggtgggagttgaggggaagttgtttttgaggggttttgtttagtgtatttggtttggttagtgattaatgttgtgttttgtttttttagatttaatgttggatgatgtaattgtttttggtagtttagttagtgttgtgttaggtattgtgtttggggtgtgggtttatgtgtgtggggatatgttttttattttttttttgtggtttattgattttatttttttggggtgaaagggtgagggtttttggggtttttaagagggtaggggttgaagtgttgggttttgtagtattttgtaggtttgtgttaaattggatgggaggtgagggtttgaggtttttttgttgatgttttttggagagtttatttttttagtaagggtttttttggttggttaagttttttattttttgttatttttttttttttgtgttttttttttgtagtttattggttgattattagagttgtaaattttttttgtttttttttgtttgaggggagattttgatttaagggagtaggatgagaggagtagagaggggaaggatttgttttaaaaatgtaataatgaataattgaatagatttattaatagttaagtgattatggtggttgtgttattgttataaatagtaggaattgggaattaaaggtttgagttggttatgagttttttttaaaaaaagttaaagatttgggagtgatttgggtttttatttttaagagttatgtttttgggaagatttttttggtttagtttattttttatggttttttggttttttgttttttttttttttattggtttttagatggaggtgtggaggtttatggagtttgtggtagggttgtggggttttataatattatgtttttagttggtggtttttaagttgtttatttttaaggtttttagttattattttttttaatagattttatattttagaaggttgtttatgaagttaagagtattttaataatgatttttttttattatttttattaattagaggtgtatttaattgttaattatagtttttgagttgtagaaggttatatattaaatgatggtaaagaaagattattttgttattaaattagtttgtggggttttaatataggtaaagtatagggttttttttaagttttttgaagtattggaaagaatataagggttgggtatagtggtttatatttgtaattttagtattttgggaggttgaggtgggtagattatgaggttaggggtttgagattagtttggttaatatggtgaaattttgtttttattaaaaatataaaaattagttgggtgtggtggtatatgtttgtaattttagttatttgggaggttgaggtaggagaattgttttaatttgggaggtggaggttgtagtgagttgagattatgttattgtattttagtttgggtgatagagtgagattttatttaaaaaaaaaaaaaaaaaaagagagagagagagtgagaatataaggatttttatggttgttgtaggtttggaattttagtttgggaattattggttttattttttttatttttttggaagttagaattaggtagatgttgttttggggatgttgggtgttatgatttgtggggttttagggatttatttaagagagaatttttgagtttttattgagtaggttatttttgaggtttttagtgttatggttttatgatgttaagtagtggtgtttggtattgagagattgtttttttggggtttaggagtttttggttggtttgtgtttggattgttagggtttttatatttttgtattaggttgttttgtaaatttttgatttgttaggggatgaggggagggagggaagaagtggtttttagttttttttttatgggtttatttggtttgtagattgaagtgtgtatatttttatatttattttaaaatattttagtatagggttagtttatagagatttttttattttgggtgttattttagaaattaatatatgtagatttttatggtttttaagatgtgatttatttatttagtgttaaatatttttgtgatttttgtattgtatttttattttgggtattttttgttgtgtttttgaagtggatagattttattgtattttggggtggtatatgtaggtatgtatattagttattttttttggttgttggtgaggatttagagattttgaataagggtttaggttattttatattttattttttaggatttggagttttgtgtggtttatgttagagttttttaaatttttatgtgtataagaattatttggaaagtataaatatagatttttggggtttattttagaggtttttttatagtagtgtagatgtattgatttatttattagggtgatggggatagagttaaatgtagtttagggttgttgagaattaaatatgtgtattgtatttttttgttagtatttttgttttggtgttgtttttagtaggggtgggagagttagattttagggaaaggtagaagagtggagtttgtgattatttggggaatgggtttgattagaagtttgggtttattttggttttttagatggagggagggattggggttgttgggttattaggttgttttatgggatggttaagtttttaatattagttttattttttttggttatttgtggtgttgatttttatttatttattttttttttttttattaggttgggatttagtgattaggtttggttatggtagttgaaggtgtggtttttgttgtggggggtttgtgtttttgggagtgatttttgttttttgtttatttattgttatttttttttgtaaattttttgttttggttatgttttgggttttttgtgatttttattaatttattgtttgttgttttgtggttttttttttgtattttttttttttttttgttttgaagtggggatttgggttgttttagatatgtttttttttttattgtttgattttggtattttttttatttaaggtagtttattttggtgggaggtagggaggtggtgttatagttattaatgtattagtgattataggtttaggttttttttggattatggttggagtttttaaagtagtaggtttgtttaaggttttttttaggggttttttattttttttttatatttgggtgtttgtttgtagagttgaggtttagagagtagtaaaggagggtggtattgttaggttttaattttggaggtttttgggtagattatttaggggtgttttttgggttaaggttttaaagttttgtgtttgtatttatttggtaattggtgagggatttgggttggaagtttgggtttagtttggttatgttttgtagttagttgaatgagttattttttgtttggttttattttttttttttgaaaaataaaggggttgtttgaggagatgttgattagattggtttggtattttttggatttgtgttttaatgggggatttttggtagttttagtatttgttgtttggggtaggggttagggtggaggggtgtttgtatagattttaggggttgggatttgtttataagtagatgttttgttttagtttttttgttttgttttttttttgggttttttggaggagggttttggttgaattgaagtttatttattttatagatttttagtgtaaggttagagttggtgggagtagttgttttgtttggtttggaattgtttatagagttaggttggggtgatggggagaggagggtaatttttttagttttttttttatattgttttagttaataatggggttaataaggagttgttttttttaatttaattgtatttaaatattttagttaattttttatttatattttagtataatgggattgggtgtttttggtatttatggagattaatgtagagaaaatgttttggttgtttaggtaatgtagggtgattagtgttttttggtttttgtggtatttaaggaaggaaggaagaggtttggtttatttggtttattttttattattgtggtgtggatgatttgtagttttttgtttttttttgttttaggttttttagttttatatttttggggttttgtttttgaataaatagagttatagttggttggttgatttttgaaaataggaagatggttttatgtatgtttaaggtgtagtagagtgttggggattgtttgttttgtggttatttatattttaaggttgatgttggagagtggttaggtgggttaggagtatggtagtttatgaggttggatgtgtaatatttgggtgtttttttttttttagttttgggtgggggtttattttaggttgttttttgttttagtttatttttttgtttaatggttttgtgtatgggaaaggatagttatatttgagttggtttgggtttaaagttttttgttgtttttaagttagttattttttggtttaggttttagaggtggtagtttttattggttggtttttttttagattttttgagatggggaagggttgtttgggatttgaggttgttatatatttttttgtgaaaagttttttttttttttgtggttttgtgggagattaatttgttaatttttttttaagaatatgtgttttaagttggtttggtttttttttagtatttggaagagggtttttttgaaattttttgtttttagatttattttgtttttttggtagtttaattttttggttttgtgatttttataattaagtggtttattaattatgagagaaatattatgtttttgatagattttagatagtgtttttagtttagtttgtagtttaaggttgtttaaatatttaggagtaggttgggtagtgttttattagaaattgggtgagtttaataggtggggtttttttagtttgagtttgggatggagtagagttttaaggtttttttttttgtttttattgatatgagggtataggaggtttaggttttgttttttggaggttttttgggtgggttagtgtagttagttaagaagatgtttaatttttaatttttggttttatttttaaattttagttttgtgtaattttttttgtttttttgaggggttgagtttggtgaaggagtaaaagtttttgtttttttgttgatggtgtgttttttgagtttgaggagattagttgttttttattgtattgatttggttttgttgtggaatattgagttgagggtgttatgaggggttggtggattttggaggttgtttaggggagggggtttatttggtgtttaatgtaggtggggggttttgtatgttttgatttattttgtttttaattgtagttagtataatagatgtttggagggggatatgtttagatggttgtttttattaaggggtagtgtggggagggtgaggatggtgatgattatggaatgttttagttttggtgttagaggttggtggttgtgagggattgggggtggaggggtgtggggggtaggggtttgatgtttgttttgtttttttttttgttttattagaagtttagtgtaaattttattattttgattatttttgtttttggttttttgtttattatttgtgtattagttattatttggatttttttattataggtgttattgggttgaatgtggttattatggttatggagtattattagtagttttaggtaggagtgagtggattagttatttggtttttttatttttagttgaggaatttttgggtaaggttaatatagtttgagttagggtatttttgtgttaagtaagtgttaggtatattatatgggttttttttgtgttttttggaggtgggtattatttttgttttatagatgaggatattgaggtttagagatgttagttgatgtggttaaggttatatagaaagggagtggaggatttggtttttttatttagtaaatgttgagtgtttattatgagttgtgttttggatttttgagggtaaaaaggtagatggatgtttgtttttttggagttgagattttagtgaatgtttagttttagagtttatttgtgattttgttatttttttagttagttttttttggttgttttttagttgttggtttttttgtttatttaatgagggggttgaatttgtaatgtataaggttttttttagttttggtatgttgtgttatttagtatatttttatgtgatttttttattattttttaaggagaaagattttttagtataaggttgatttatttatgtgaataagtgttttatttttttttggggtttggtggttaatggttagttattatgatgggaatagagaagatagggttttttggagtttttttgttttttagatttgggtggtatgatggaggggtggggggataagttttagttttgggttttaagggattttgtattttgtttttatttttgttagattttggatgaggttttgaagatttgtaattatatttttattgttatttttgttttggagttagtttttaaatttgtggtttttggtttttgttggtttttttaggataggtaatggagaaaaggggggttttggggatttgtgtagagatagaaaggaatgagttttttggggaaatatttaggaagatttagtgtttaagattttttttaatttttgaggtttagtttttattttgtggttgatgtaggggattaggggatgggaaggtatggtttttaggattaggagatgggaaggtatggagagaatttgataagatagggtttgggggatgttggtagttagaaattagtgtgatttagtttggggtttaagagtatagagtttggagttagattgtttgaattggatttgaattttggttttattatttagtagttggtggttttgggtaagttatttaatttttttgtgttttagtttttttatttgtaaaatgagagaaaataatagtatttatattatagagttgtgagattatgaatttttatttggttttgagggtgttttttgttttgttttgttttgttttgttttttgatgtttaggttggagtgtagtagtttagttatggtttatagtagttttgattttttgagtttaagttgtttttttattttagttttttaggtagttgggattatgggtatttattgttatatgtagttaattattttttatttttatttttagtagatatagggttttattatgttgtttaggttgtttttgaatttttgagtttaagtgatttttttattttagatttttaaagtgttgggattgtaggtgtgagtttttatttgtaaagtttttaaaagtgtttggtgtatagtgaatattatataagtgttaaattaaaaataaaagtaaatgaatataaatgaaaagtagaggtttttgagttaaagttttagttttatttgtgttattagttggttgtgtggttttagataagttatgttttttttttgtgggatgggaggttggatttgttgatgtttgttttttttttaagttttgtttttttgtgttatgattgtttttttttttaggaatttttttttttaatttagggagttgtattttgggttttttaggtggaattagttggatttggttattgtgttgttgtttattatgggtattatgttggaggaaattgaggttaatgttttgttgtttattaattttattattatttgtattatgagggtgttgtgtattgtttgaggttggtgtttagtttatgtatttgtttttttagggtgattagtttagggagagagagtaagggttggttttgtggttggttaaggtttgggtggttgtgggtttttatgggttttttttttagtttttgttaagggaggttggagatagggttgaggatggggatgtaatttggttggtttggagatggttattttagtagttttagtttagttttggttttgattttgttagttgtttggttggggatttaaagaggttagtttatgatgttgttttgttttgtagtgttgaagttgttgaagatggttgtgggtatgtgggtgttgttggatatggtgatgtaggttttgttttaggtagttgggaggtggggggtttttggggagggggaggtgttttttagagggaaggggtttagagaagttgattgggagatttagtggtattgtttttattttttttttttttttttaggtggggaatttgggatttttttttatgttgttgttttttatttttgtagttttgggtgtggagttttttggagatttgggtgagttggggtaggggagggtggaggagttagggttggagattagggggtttttggattaatatgggtttttttttttttttttttttttttagagtgtgatgagatatatttttgtgagggtttgggttgttatgttattttttggaattttggtatggtttttttaatttttttttgagtttttataggtgataattggaatggtattatgaaggtaagggtttagggttggtttaggttttagggaggtagttttattttttgagttaggattttttgggaagatgaattggttataaataaaagtatgtgatttttttttttttgtgttagaatattttggaatttttttttttaggaatatgttttgatttatatttgtagtgtttttttgtttttaaatatttttttttttttttttttttttttattttttaatgttttgtgatattagtgatttgattttttataatagttttaataattgttttttttagttttatttttttattttattttttttaggatattttttgggattgtgattaggagtttatttgttataatatggttattttgtttatttattttgtgttttttgtgttgatggtttagtttgtgttagttaatgtggtgattgttgtgttgatgaagtatttggaggagagtaataaggaggttaaggaggaggttgagttagaggttgagttggagttggagatgaagatttttagtttttagttttatttgttattgggtagtttttttttttggtttggggttgagggttttgatagttttgatagttttaagtttggggttttgtatttagtggtttatgtgagattagttttttatttttttttggagtattttatggtgagtagatatttattttagttgtgagaggagttggggtaggagaagggtgtggagggtggtgggtgggagttaagtgggtagtatataaattttaggttttttttggaggtttttgttttttgttttggatgttgagtgagtagttattgtttttttttagggatggttgtttatatttattttatagggttattttagtagatgggttagtttagttatgttttgtttttttagtttggtttggttttttttttttgatttataggtttaaggttaagttttttgttttttttttgttttttttttatttttgtttaattgttaaattttttttttatttattttttaatttgtttgatttttttttatttttttatttttttattttttttttattgttttttttttttttttttgttgtgggttttgtttattttttattttttatttttttttttttttttgtttttttttttttttatttttttttttttttttttttgttgttgtgtgtgtttttgtgtgtgtgtatatgtgtatgtgtgttgtttgggtgttattttttttttttttgttttttttgttaatttttttttatgatattttttattattgttttttgatttttgtttttttgtttttttggttttttttatgggttggttttttaggataggtagttgtttgatattatatttttgttgatttagggttttttggagtgggagttgaagttgatggatgagttggtaggtttagggggttagttttttgtttttttttttgtttttagtttgggaggttttgatttataggttattgtgtttttgtgttgtgtttttttttttgattgtgttgggttgtgttatgttgtgttatgtttttggggaagttgggagtgtttttgtttattgggtatttgtagaaagtgtagttttggagttttagttgagtgtaagaggtagttaggggtttttttagattgagattatttttagaaaagagttggaaggtagggttgttgagattgtttttttgatgagaagggtgtgtggaggaggagtttggggaggggagaggggatttgtaagaatttggaagagaaaagaggggatggggtagaagataagttagtagggggattttagggggtggagggaaggaggtattagatttagggaggaaggtttttagagatagtgtaggtggttagggagtttgttgttaagttgtagtttttttatttgtttgtgtttagtatatatttgttagtttttagtttggtggttttttaagttatggagtttattgggtatggtgagtgttgttaggagttattgatttttgttttgagagagatagaaggttttagttgggagtggattttgagaatttggtgtgaaataggatttggttttttgtttaagtttagtttttttttatagtgttatatggtttttttttttagttttatttaattttaggttttttgttttttgggttgtttttgttttttttttttttttttgatttttttattatgatttattattatgtgagagagggttttattttttttttatttaggtgagaggttgtagatttggagtggagataggtgttagttgtagatagaaaagttgagttttttagaggtttttttgggtggtggggtaggtaggtttttaggaagtttttagtttgattttagaaaaatggatagtgatttttatgtgggaagggattttgttttttgttgggatttagttttagatttggtaatgatttagaatgattagtgggaaagtgagtttttttttgaggttttttttttttgaaagaggtttatagggaaaggttgtgggagaagaggatatgatgggaaggtgatggggttttgggagggatggtttaattgttttttagtattttgtgggtattgaggtaattttttgggttttaggtgagttagttagatggtgtggtagtttatttgagtgtgtttattttaggttaatgggagaatattttttagagtttaagttggagagggtgggtgggttgtaggtaggtggaggagggtttatgaggggagaagttagaatttgggggtaggttaagttttgttaggttgttggaagttgagagaataggtagaaaatagttgttagattggtggtattgttgttggtgttttttgtgttgttttgtttgtgttgggaggagagatagtgttttgttggtttttttttattttttttttttttggtattatttttttgagagttgtaagtttttggtttttttgttttttttttgggtggtggtagtgtgggaggggttggggaggtttttggggtatttttagaatgtgtttttgtgtttttttgttttgttagtgtttgttttggttttttagtgtttgttgtagtttttttgattagagtagggggttgaagtgggtgtggggaggtattgttagtttgtttggggaaagggtggggagagagaagggatgttttttttttgtttttttgtgttttgtgaaaagggggaagtggggattgagagagagtgtgtgtgtgtgtgtgtatgtgtgtgtgtgttgttttggttttttatgtttgattatttttttttttgtttagatttttttagttgagatggaggttttgtttttgatgttagagattgtgtttgaattgttttgttttttagttttgatggatgattttttgtttgatgatatgtatatatttttatttagtgttttggagagtaatgtatatatatattgtttttattgtttttggttatttttggggttggattggttgtagggttttagattggtttagggagggttttggggttgtttttttttagtttgttgttaggttttatttagaggtattaattgttaggattttggtggtttatgttttgttggtataaggtttttaggttttttattggggataaagagattagataagtttaaattggggttttgttttgaagggtataggagtagtggtagttattatgaaaaagtgaatttagatatttaggagtgatatggtttaaaataggtgttattagagttaatttatgaatttggagttttgtgtaagttagttttttttgtgtttgttttttttttttttattttattttattttttaataatatgagatttttatattatgtggtgggtgagagttgtatttttgttattgttgttatgtttttttttatttggagtgttgtttttgttttttttgttattgtttttgtgtgtttttgtgtttttattaaatttagtggggtgaatggggtttttttgtgttttgatagtttttttatttttttttttttttagtttttgttttttttgattgtgagtagtttttttttttttattgttttttttttgttgttagaggagggtttagttgaggtagggattggattattggttggggtgtttttaggggttttgggtggttggtagtagtggagtttggggttgagaggggaagtaaaataagattgttttttaatttagttatttttaggtttgttggggttatttaattggttgggtttgtatggtgatagggtttttatagtttttttgggaataaggggtgaagggtttagggggaagggggttatagagtgatggagaaattttttgagaataaattaggtttttttatgttggagtttaaggttgagtattttttttttttgaaatagagtaataattttatttttattttgagtttgtttattaagggagtagttgaatttggtttttatttttatttgttagagttattggttaaagtggaggttagggagttagttgtgatatgtttttggtggttatttgttatttaatttatttgaatttaatttaggttttgtgttgggatttggggttgttgtaagaattggatgaatagtttgtaatttgtaagtttttttgagttgtttggtttttgttttttgggagggtttttttttttttattttttttattgatagtatagggttgtaggggttgttgttggtttttttttttttttttttttttgagatagggttttattttgttgtttaggttggagtgtagtgatatgattttagtttattatagttttgatttttttggtttaagtaatttttttattttagtttttggagtagttgggattataggtgttatgttattatatttagttaatttttttttttttttttttttttttttttttagaaatggggttttgttatgttgtttaggttggttttaaatttttgagtttaagtgatttgtttattttggttttttaaagtgttgggattataggtatgagttattagttattgtgtttggtttgttgttagtttttaatttttttttgagttgttttgggttagggttttagtttatttttgtggatattgggattttttttagagtttttaaatggggtttttagaattagtttgtgagttatttgtagggttgggggttgggggttgtttttttttttttggatatttttttgtttttttattattatagtgggagtttaaaggtgatataatgtgtgtagttttgtagggggtggggggtagggtttgtagatttttttggttgtttagatttttttttatttgttttttttttgtgtgtggagggtttatttatgtgtttgtttttttttttagttatgtttatgtttatttttattttgttttgggagggtatgggggtgagggttgggtggggggtgttgttgttttttgttgttagtgttgttttagttattaaatttatgtatattttttttttttattttttttttttgttttttttgtagatgtagttttattttatggagttgttaggattagatttattgattgtgtggaagtttggggttagttgaatgtattttttgtttaatgatagttatatgtgttggtatgggagtattgttgaggggtttttgggatataggggttgggggttttttaaagtttagttaggtattagggttagagtaggttaatttggtttatatagggagattttattttggtttaagttagttttgatttgaggggatggggaattgaggtagttaaagaggtatttttgattttaggggagtttttagtttgggggaatggttttgagtttagggggtaagggtagaggttttgatgagggggagagagtggaagggagggtttaggtgagaatttgtttttttgaattttttagttttattttttttttttattttttttttgtttttttttttttataggttttgttttgtttgtttatttttagttagtagatattagttatattttgtagttttttaaagatgtattttatttgttttagttttatagtgttttaatttggggtattatttttaaattgtttttattaggatgtttttttttggtttagaggttatttaggtgttaggtgagtagatgtggaaaggtaggtataggtttgggggttggattttttgttgttggtgatgatttgtgttgatatttttatttttttagtaaatatttattgtgtgttagtgatgtgttaggtttagttgtagatattagggatatagtattgggtaaagtagaagtggtttgtgtttttttgaaatttgtatttagttttttgttttattgaggaggtttggagattagaaggggtagtgtttgtttagggttatgtttatttggttggaggtagaattttagtttttggtttttttttttttattaattagagttgttttttaatttttttttttattttggattgagttatggggtataaggtaggttttaagtgtttttatttttggttaagtttagggtttattttttagagtttagatttttttttttttttttttttttgagttttgtttttgttgtttaggttggagtgtaatggtataattttggttttttgtaatttttgttttttgggtttaagtgatttttttgtattagttttttgagtagttgggattatagatatgtgttattatgtttggataattttgtatttttagtagagatggggtttttttatgttggttaggttgagtttgagtttttaattttagatgatttggttgttttggttatttaaagtgttgggattataggtgtgagttattgtgtttggttttagagtttatttgtgataaggttatagtttatgttatgtgtgtgttttgaggtatgagtgtggatatatgagaattttaattttatatgtttgggggagtaggtatagtttttatttattttgtaaatagttattaagtagtttttgtgtgttaggtattggtgatatagtttttgttttttgaagtttatagtttaatagtggagatatgtttgttattagattattgtagttttagtttatagttgttagatatttatgtgtggagggtagtagggatatagaaggggaaggggttggttttatttggggatagagattgttatatattgtgttatagagaatttgagtttgtaaaattgagggatttttgttaattaggaagggtatttagagttaaaggggaagtttaggtagaggtggggaggtgtgaaggagttagtttagtgagtagagatggtttggttttttttatattttaggaggtaggggttgtagagagagtgatttttgtaggtttaggggagattagagtatgggggagggaagatagggtttagtggggagagaggaggtatggtggataatagaggttaggttgtaatgatttttatttattagtaagagtggttattaggatttttgtttaggatagttttgttgtgtttggtggtggtgggtagggggtatagttagtttgataggagggttagtttatgttggagaggagattgttgggttgagtttttttttattttatataggtagtaataaggattgattttttggatgtttagggtttgggtagttgggaagatttgttggtagaggtgagtgggttttttttgtttttggtttgggtttattttttttggggttagttaagtatttaggtatagtagtatttttgtagttatagtaagatttttaagtatatgattttgttagttttttgtttaggtttagaatttaattggggtaagggttttttagagattagaagtagtttagagttggatatggagttgagttggattttaggagattttttgttttttggtggttaggaggagtttttatttttatgggatttgaagaagtgttatagtgtggaggtttagagttgttagtgttggtttatgttttggttggatgagtagaggagatattttattgttgttagttgtttggatagtggtttttaattttatttgggtatagatttttttaattttgggggttagttttttggggggtttgggagttggtttaagaaaaaatttagtttgtttagtattattatagatttttttgagagttaaggtttttggattttgtttagttttggtatttgtttttggaggagggttttgtttagtgattttaaggattttttggtttttggtttttttgatagtatggttgttttgttttttttaaagaaagatgtgttgagtttttttggtttattttttgatttagtagatttggatttttgagttttgttttatttttttatttatttttttttattgggtgttaagttttagtttttttttttgggttatatttttgataaaagttttatatagatattaaggaggtggaggtgtttttttttgttttagtggttttgggtatttgtaagtagaatttttaaagagagttaaaagtagtagttttggtaattttggttttaggtagaaggagaggtttggtgtagttgaggtttttgatattagaagttgttgggagaaagtaatatgtttgtgtagaatttttatgtatattttattttattaaattaattgaatttagtatatgtgggatgtatgatattttgtgattgaagagatttgtttttttttatttttatgtgttttagaatatttttgaggtgaaggtgtttgttttttggttattttaatttaaaataatagtttagttatattttttttttttgtaaagtataagttgggattgtgagtatattgtagttttaatggtggtttatttttagtggagagtgagaattattttggaaattgtaatgtaatttatttttttttttaattttgttattattttttgtagggaaaaaaaaaagaaaaagaaaaaatgagatttta

SEQ ID NO: 231 - DNA, 67922 bp, Artificial Sequence
  Chemically-Treated DNA
taaaattttatttttttttttttttttttttttttttatagaaaatgatgatgaggttaaaggaaaaaataagttatattatagtttttaaaatggtttttgttttttgttgaagatgggttattgttggggttgtaatgtgtttgtggttttagtttgtgttttgtaagaagagggaatataattagattgttattttaggttaaaatagttaagagatagatgtttttgttttaaaaatattttgagatatataaaagtagaaggaaataagtttttttagttataaaatgttgtatattttgtatatattagatttaattaatttaataaaatagaatatatatagagattttgtataaatgtattgtttttttttaatagtttttggtgttgggaattttagttgtattgggtttttttttttgtttggagttagagttgttggggttgttgtttttaattttttttggaagttttgtttgtaggtatttagagttattgaggtagggaggagtgtttttgtttttttggtgtttatatggaatttttgttaggaatatagtttaggaggaggagttaggatttggtatttagtggagaaaggtgagtgggaaagtggggtaggatttaggggtttaggtttgttgggttagaggataaattggagagatttagtatatttttttttggggagggtgaggtagttatgttgttaggggggttagaggttaagggatttttggagttgttggatggagtttttttttggaggtagatattagggttgggtggggtttgaggattttggtttttgggggggtttatggtgatattaggtgggttgagtttttttttgggttggtttttaggttttttaagaggttggtttttaaggttagaggggtttgtgtttaggtggggttgggagttgttgtttaggtagttgatggtgatagagtgttttttttgtttatttagttaggatgtaggttggtgttggtagttttgggtttttatgttgtagtatttttttaggttttgtggggatgggggttttttttggttgttagggggtaggaggttttttgaaatttagtttagttttgtgtttaattttaagttgtttttggtttttggagggtttttgttttagttgggttttgggtttgggtaaggggttggtggggttatgtgtttggagattttgttgtggttgtgggagtgttgttgtgtttgggtatttgattggttttagaaagagtaggtttgggttaggggtggggagggtttatttatttttgttagtaggtttttttggttgtttagattttgaatgtttaaggagttagtttttattgttgtttatatggggtgggggagggtttagtttagtagttttttttttagtatggattagtttttttgttaagttggttgtgttttttgtttattattattaggtatagtaggattattttaagtagaggttttggtagttgtttttattagtagataggggttattgtagtttgatttttgttgtttattatgttttttttttttttattaaattttgtttttttttttttatgttttggttttttttaagtttgtaagaattgttttttttgtagtttttgttttttgggatatgagagaagttaggttatttttgtttattgagttggtttttttatgtttttttgtttttgtttagattttttttttggttttgaatattttttttgattggtaagaattttttgattttatggatttaggttttttgtgatatagtgtgtgatagtttttgtttttaagtaaaattgattttttttttttttgtgtttttgttgttttttatatataggtgtttggtagttgtgagttgaggttgtaatgatttgatggtaggtatgtttttattattagattgtgagttttagggggtaggggttgtgttgttagtgtttggtatatagaggttgtttagtgattatttgtagaatgaataaggattgtgtttgtttttttaagtatgtgggattgagatttttatgtgtttatgtttatgttttaggatatatatatggtatgggttgtggttttattataggtgggttttggggttgggtgtggtggtttatgtttgtaattttggtattttgggtggttgaggtggttagattatttgaggttgggagtttgagtttagtttgattaatatggagaaattttatttttattaaaaatataaaattatttaggtatggtggtgtatgtttgtaattttagttatttgggaggttgatgtaggagaattatttgaatttaggaggtggaggttgtggggagttaagattgtgttattgtattttagtttgggtaataagagtgaaatttaaaaaaaaaaaaaaaaaaaagaatttgggttttggaaggtgggttttaggtttggttaaaagtgaagatatttaaaatttgttttgtgttttatagtttagtttaaagtggggagaagaattgggaggtagttttggttggtgaggaaggaaagattagagattggggttttatttttgattagataggtatgattttgggtaagtattattttttttggtttttaggtttttttagtggaataaggaattgggtgtaaattttaagaaggtatagattatttttgttttgtttagtattgtgtttttggtatttgtaattgagtttggtatattattggtatataataaatatttgttggaagaatgaaagtgttaatataggttattattagtagtagagggtttagtttttaggtttgtgtttgtttttttatatttgtttatttggtgtttgagtggtttttgagttaaaggggagtgttttggtgggggtagtttggggatggtgttttaggttggggtgttgtggggttggagtagatgaggtgtatttttgggaagttgtaggatgtagttggtatttgttggttgggagtgaatggataagatggagtttgtggagggagggaagtgggggaggggtggggggagagaatggagttggagggtttaggggagtaggtttttatttgagtttttttttttatttttttttttttattagggtttttatttttattttttggatttaaagttatttttttaggttggaggtttttttgaggttagagatatttttttggttgttttagttttttatttttttagattaggattggtttaggttaggatggaatttttttgtgtgagttaaattggtttgttttagttttggtatttgattgagttttggggagtttttagtttttgtgttttaggggttttttggtagtgtttttatgttgatatatgtagttgttattgggtagagagtgtgtttggttgattttagatttttgtatagttagtaagtttggttttggtagttttgtggggtggggttgtatttgtaaaaggaataggggagggaggtggaggaagagggtgtgtgtgggtttggtaattgaggtagtgttgataatagaaagtagtagtgttttttgtttagtttttatttttgtgtttttttaggataaggtagagatgggtatgagtatggttggggagaggggtagatatatggatgagttttttatatgtggggaggaagtaggtaggagggggtttgggtagttgggagagtttgtaggttttgttttttattttttgtaaaattgtatatattgtattatttttaagtttttattgtggtggtggaggggtggggaggtatttagagaagggagagtagtttttagtttttagttttgtaggtggtttataagttgattttaaaggttttatttagaggttttgaagggagttttggtgtttatagggatgggttggggttttgatttagagtagtttaggggaggattaaaagttaatagtaggttaggtatagtggttggtggtttatgtttgtaattttagtattttgggaggttaaggtgggtagattgtttgagtttaggagtttgagattagtttgggtaatatggtaaaattttatttttaaaaaaaaaaaaaaaaaaaaaaaaaaaaaaattagttggatatggtggtgtggtatttgtaattttagttattttagaggttgaggtgggaggattgtttgagttgggggggttaaagttatagtgagttgggattatattattgtattttagtttaggtaatagagtgagattttgttttaaaaaaaaaaaaaaaaaaaaaagttaatagtagtttttatgattttgtgttgttagtgggggaggtgagggggagaggatttttttaaggagtagggattaggtagtttaggagagtttgtaggttgtaggttgtttatttagtttttatagtagttttaggttttagtatagggtttgggttgggtttaggtgagttgaatggtagatgattattagaggtatgttatagttggttttttgatttttattttaattaataattttggtaggtgagggtggaggttaaatttagttgtttttttagtggatagatttggggtgggagtggggttgttgttttgttttagagaagggaggtatttagttttggattttagtatgagggagtttagtttgtttttaagaggtttttttattattttgtgatttttttttttttgaattttttattttttgtttttagggaggttgtaggggttttgttgttatgtaggtttagttagttaaatagttttagtaggtttgaggatggttaagttggaggataattttattttgtttttttttttagttttaggttttattattgttagttatttaagatttttagggatattttagttggtggtttagtttttgttttagttgggtttttttttgataataggaggggaatagtggagaggagggggttgtttatagttagaagggatgggagttggagaagggaaagggtagggaagttattagagtatagagaagttttatttattttattgagtttggtgaagatgtagggatatatggggatagtgatggaggagataggaatagtgttttaagtgaagaagggtatggtagtggtggtagagatgtggtttttatttattatgtggtgtgaaggttttatgttgttggggggtggggtggggtggggaggaggggaataggtatagggagggttggtttgtatagggttttaaatttatagattgattttgatgatatttgttttgggttgtgttatttttgggtgtttggatttatttttttataatggttgttgttgtttttatattttttagggtaaggttttaatttaaatttatttaatttttttgtttttagtggggaatttgaagattttgtgttagtaaagtgtgggttattgaggttttgatagttgatgtttttgggtggagtttggtagtaaattgagaggaggtggttttaggattttttttgggttgatttggagttttgtagttagtttagttttgggggtggttgggagtagtgagggtagtgtgtatgtatattgttttttagggtattaagtaagagtgtgtgtatgttattaggtaaagagttatttgttagagttagagagtaggatggtttagatataatttttgatgttagagatagagtttttattttagttagagggatttagatagggagagagatgattaggtatgagaaattaggatagtgtatatgtgtgtgtatatgtatatatgtgtttttttttagtttttatttttttttttttatgaagtataggggggtgggaaaaaggtattttttttttttttttattttttttttaaataagttgatagtgtttttttgtatttattttaattttttgttttgattagagaggttgtggtaggtattgaagagttagagtaaatattgataaagtgaggagatatagaaatgtattttaaagatattttaggagtttttttagttttttttatattattattatttagggagggagtgggaggattgagggtttgtgatttttaaaaagatgatattaaaaaaaaaaaaaatgaagaaaggttagtaaagtattgtttttttttttggtatagatagagtggtatggggggtgttggtgataatgttattaatttgatggttgttttttgtttatttttttggtttttaatagtttggtaggatttggtttgtttttagattttggtttttttttttgtgggtttttttttgtttgtttgtagtttgtttgttttttttaatttgggttttgggagatgtttttttgttagtttgaagtgggtgtatttgggtgggttgttatattatttggttggtttatttgggatttagggggttgttttagtgtttataggatgttaggggatagttggattgttttttttagaattttattatttttttattgtgttttttttttttataatttttttttgtgagttttttttaggaaggggaggttttggaaagggatttatttttttattgattattttaggttattgttagatttgagattgaattttaataagaggtaaggtttttttttatatgaggattattgtttatttttttgggattaggttaaaggttttttaagaatttgtttgttttattatttaaaagggtttttggaggatttggtttttttatttgtagttgatatttgtttttattttgggtttgtagttttttatttaggtggagggagggtggggtttttttttatgtggtagtgggttgtggtgaggggattaaggggaggggaggagggtaggaatagtttagaaagtagaagatttggaattaaatgggattgggggagagggttatgtggtgttgtgggaaggggttgggtttgggtaggaagttaagttttattttatattaagtttttaaaatttatttttagttggagttttttattttttttaggatagaaattagtggtttttgatagtatttattatgtttagtgggttttatggtttaaaaagttattaaattgaggattggtaagtgtgtgttggatatgagtagatagagagattgtagtttggtagtgggttttttggttatttatattgtttttggaggtttttttttttggatttgatatttttttttttttattttttaaggtttttttgttaatttattttttgttttattttttttttttttttttagatttttataaatttttttttttttttttaagttttttttttatatattttttttattagaggggtaattttagtagttttgttttttagtttttttttggaggtgattttagtttagaagaatttttgattgttttttgtatttaattgaggttttaaggttgtattttttatagatatttagtgggtaggaatatttttagtttttttagaagtatggtatagtgtggtatagtttagtatggttaggggagagggtatagtataggggtatagtaatttgtgggttggagttttttaggttgggggtagaagggaaggtagagggttggttttttgggtttgttagtttgtttattagttttagtttttattttagggagttttggattagtagggatatggtgttaaatagttgtttgttttggggagttagtttgtaaggggagttggagaggtaggggagtaggggttagagggtagtgatgggaagtgttgtggaaggggattgataagagaaatagaggagaaagaggtgatatttagataatatatatgtatatgtgtatatatataaaaatatatatagtaataaagagaaaaagaggagggggtggggaagagggaaggtgaaggaggaaggagagatgggagatggaaaatgagtagagtttatggtggggggagagagagagagtggtaaagagaagataaaaggatggagagatggaagagaattaggtaggttaaagggtgggtaggaaagagatttggtagttgggtaagggtaagaaagaaataggaaggaaatagaaaatttagttttgaatttatgagttaggaaggggaggttagattaggttggaggagtagggtatggttaagttggtttgtttgttggggtggttttgtggggtgagtgtgggtagttatttttggggaggggtagtgattgtttgtttagtatttaggatggagggtgggagtttttaggaggagtttagggtttgtgtgttgtttgtttggtttttgtttattattttttatattttttttttgttttagttttttttatggttggggtgggtgtttgtttattgtggggtgttttagggaaaagtgggaggttgattttgtgtgggttgttgggtgtagagttttaggtttggggttgttggggttgttggggtttttgattttaggttagaggaaggggttgtttagtggtgagtggggttgggggttgagggtttttatttttagttttagtttagtttttagtttggttttttttttggtttttttgttgtttttttttaggtgttttattagtatggtgattattatgttgattagtatgaattgggttgttagtatgaaggatataaagtagataggtgagatgattgtgttgtagtaggtggatttttggttatagttttggagggtgttttggggagggtggaatagaggggtgaggttggggaggatagttgttggagttgttgtggaaaattaggttattggtgttatagagtattggaggatgggaaggaaggggaggaggagggagtgtttgggggtagaggagtattataagtgtgagttagagtatgtttttgggagagggagttttagagtgttttagtatgggggagagaaggttatatgtttttatttgtggttaatttatttttttaaggaattttagtttaggaagtggggttgtttttttggagtttaggttaattttgggtttttatttttataatgttattttaattgttatttgtggagatttggaagagggttaggaaggttatgttaaagttttgaaaggtggtatgatggtttaggtttttataggggtgtgttttgttatattttgggggaggagggaaagggggagaggtttatgttagtttaggagttttttggtttttagttttggtttttttatttttttttattttaatttatttaggtttttaaagagttttatgtttagagttgtaaagatgaaaaataataatatgaagagaagttttaggttttttatttggaaaaaaggagaagaaatagaaatgatgttgttgggttttttagttagtttttttgagttttttttttttggaaagtatttttttttttttagaggttttttattttttggttatttggggtagggtttgtattattgtgtttagtagtgtttgtatgtttatagttatttttagtagttttagtattgtagaataggataatgttatgagttggtttttttgggtttttggttagatagttggtagagttaggattagggttgggttggggttgttgggatggttatttttgggttagttaggttgtatttttatttttagttttgtttttagttttttttggtagaagttgggagaaagatttatgggaatttatagttgtttaggttttgattagttataaagttgatttttgttttttttttttgggttggttattttaggagggtaggtgtgtgggttgggtattaattttgggtaatgtgtagtatttttatgatgtggatgatggtggggttgatgggtagtgaggtgttgattttgattttttttagtgtgatgtttatgatggatagtagtataatggttaggtttagttggttttatttggaaagtttagaatatagttttttgagttgggggagggggtttttgaaggagggggtagttgtggtatagaaagatagggtttgaaaggagggtagatattagtgggtttagttttttattttatagagaagaggtgtggtttatttaaggttatatagttaattggtggtatgagtaggattaggattttagtttaaaagtttttgttttttatttgtatttatttgtttttatttttaatttagtatttatatggtgtttattatgtattaggtatttttaagagttttataaataggaatttatatttgtagttttaatattttgggagtttgaggtgggaggattatttgagtttaggagtttgagaatagtttgggtaatatagtgagattttgtatttattaaaaataaaaataaaaaataattagttgtgtgtggtagtgggtgtttgtagttttagttatttgggagattgaggtgaaaggatagtttgaatttaggaggttaaggttgttgtgagttatgattgagttgttgtattttagtttgggtattagaaaataaaataaaataaaataaaatgaaaaatatttttaaaattaaataggaatttataattttataattttgtgatgtggatattattatttttttttattttataaatgaggaaattgaggtatagagaggttaagtaatttatttaaggttattagttattaagtggtgagattaggatttaaatttagtttaggtagtttggttttaggttttgtgtttttaagttttaggttaggttatattgatttttagttgttagtattttttaggttttgttttgttaaattttttttatgtttttttattttttggttttggagattatgtttttttattttttagttttttatgttagttatagggtgggggttgaattttaggaattaagaaaagttttagatattaggtttttttgggtatttttttaagagatttatttttttttatttttatgtaagtttttaagattttttttttttttgttatttgttttggaagaattgatggaaattaaaggttataagtttgaaaattgattttaagataaagatgatagtgaagatgtagttgtagatttttagagttttatttagaatttggtagggatgggggtaagatgtagggttttttaaggtttagggttggggtttgtttttttgtttttttattatattgtttaggtttgagaggtaggggaattttaaggagttttgttttttttgtttttattatgatggttggttattagttattaaattttagaagggagtagggtatttatttatatgaatgaattaattttatgttaaaggatttttttttttgggagatggtgaggagattatatgagaatgtattagatgatatggtatgttaggattggaaggggttttgtgtattataaatttaatttttttattggatggatagggaaattgatggttggaaggtagttaagggaggttgattggagaagtggtaaggttataggtgagttttggagttggatgtttgttagaattttaattttagaagggtaggtatttatttgtttttttatttttaaagatttagagtgtagtttatagtagatgtttaatatttgttggatgaagaaattaggttttttattttttttttgtgtgattttggttatattaattaatatttttgagttttagtgtttttatttataaaataaagatgatatttatttttaaggggtataagaggaatttatgtagtgtgtttagtatttgtttggtatagaggtattttggtttaggttgtgttaattttgtttagaggttttttagttggaggtgggggggttagatggttggtttatttgtttttatttggggttgttggtagtgttttatggttatggtgattatgtttagtttgatgatatttgtgatgaagaggtttaggtagtggttggtgtataagtggtggatgaggagttggaagtgggagtagttggagtagtaaggtttgtattgggtttttgatggggtagggggaagagtagagtaagtgttaggtttttgttttttgtatttttttatttttagttttttatagttattagtttttaatgttagaattgaaatattttataattattattatttttgttttttttatgttgttttttggtgggggtagttgtttgggtgtgtttttttttaagtatttgttgtattggttgtagttgagggtaggatggattaggatatgtagagttttttatttatattagatgttaggtgagtttttttttttaggtagtttttaaaatttattagttttttataatatttttgatttagtgttttgtagtaaggttagattgatatgatgaaaaataattggtttttttaggtttagaggatgtgttattaatggggaggtaaaggtttttgtttttttattaagtttagttttttgggggagtagaggagattatatagagttgggatttggagataaaattggagattggaaattggatatttttttggttggttgtattgatttatttagagggtttttagaaggtggggtttgggttttttgtatttttatgttagtgagagtaagaggggaggttttggggttttgttttattttagatttaagttgggagggttttatttgttggatttatttagtttttaatgaggtattgtttagtttgtttttgggtgtttgggtagttttagattgtaggttgggttggaagtattgtttgagatttgttagaggtataatattttttttgtaattagtgaattatttagttatgaaaattatagagttagaaggttgggttgttaaggaggtagaataaatttgggggtaggagattttaggggggtttttttttaggtgttgaggaagggttaggttaatttggggtatatgtttttgggaggaagttgatagattggttttttatgaagttatagagaaggaagaggttttttatggggaggtgtgtggtagttttaggttttagatagtttttttttgttttaggaggtttagggggaagttagttagtgagggttgttgtttttgaggtttgagttagggggtagttggtttaggggtagtaggaagttttgggtttaggttagtttagatgtaattgtttttttttatgtataggattattgaatagagaggtaaattgaggtaaggagtggtttggggtgggtttttatttgaggttgaaggaagaagagtatttaggtattgtatatttagttttgtgggttgttatgtttttggtttatttggttattttttagtattggttttgaggtgtggatgattatggagtagatagtttttggtattttgttgtgttttaggtatgtatgaggttatttttttgtttttagagattggttagttaattgtggttttgtttgtttgagaatagagttttaagagtgtggggttggagagtttggggtaagggaggataggaggttatgggttatttatattgtgatggtggagggtgggttgggtgggttgggttttttttttttttttttgagtattataagaattagagggtgttagttgttttgtattgtttgagtagttggaatattttttttgtattaatttttataaatgttgagagtatttgattttattatgttaaaatatgaatggagaattaattaaaatgtttgaatataattaggttagaaaaagtggttttttattagttttattattagttgagataatgtagaggagaggttgggagagttgtttttttttttttgttattttagtttgattttgtaggtagttttaggttaaatggagtagttgtttttattaattttggttttgtattaggagtttgtggggtgggtgggttttaatttagttgggatttttttttaagaggtttagaaggaaggtggggtaggaggattgaggtagggtatttgtttatagataggttttggtttttgaggtttgtataaatatttttttattttggtttttattttagatggtaggtgttgaggttgttagaaattttttattagagtataggtttaaagagtattaggttaatttgattagtatttttttgggtaatttttttgttttttagagggagagaatgaagttaggtaaaaagtgatttatttagttagttatgaggtatgattgagttggatttgaatttttagtttgagttttttgttagttgttaggtgggtatagatataaggttttgaggttttggtttagaggatatttttggatggtttgtttaaaggtttttaaagttggggtttggtgatgttatttttttttgttgttttttggattttggttttgtaggtaagtatttaggtgtggagaagaaatagaaagtttttgggaggagttttgggtaagtttgttgttttgagagttttaattatagtttaggaggagtttggatttgtggttattgatgtattggtagttgtggtattatttttttgttttttattaggatgagttgttttaggtggagaaaatattagagttagatagtggggggaagggtatatttagggtagtttaggtttttattttggggtagggagggaggaagggtatagaaggagggttgtaaggtaataggtagtgagttagtaggagttatagggagtttaaggtatggttagggtggagggtttgtaaaggggagtggtaatgagtaggtagaagataggggttatttttaaggatataggttttttatggtagaggttatatttttagttgttgtggttaggtttgattattgggttttggtttggtggaaggaaagagggtgagtgagtgaaggttgatgttataggtggttaaggagagtggagttggtgttggaggtttagttgttttgtggggtagtttgatgatttagtagttttggtttttttttttatttgggaagttggggtggatttaggtttttggttaggtttattttttagataattataggttttgtttttttgtttttttttagggtttggtttttttgtttttgttgggagtagtattaggataggagtgttagtagggaggtgtggtgtatgtgtttgatttttagtagttttggattgtgtttgattttgtttttattattttggtgggtagattagtgtatttgtattgttgtaggagaatttttggggtaagttttaggaatttgtgtttatgttttttaggtgatttttatgtatatggaagtttgaaaagttttggtataggttatgtagaattttaggttttaggaagtgggatatgggatgatttgagtttttgtttggggtttttgagtttttattaatagttagggaaggtaattggtgtatatgtttgtgtgtgttattttaggatatagtggggtttatttattttaggagtatagtagaaggtatttggaatgggagtgtagtgtaagggttatgagagtgtttagtattgagtgggtgagttatgttttaggagttatgagagtttgtatgtgttgatttttgggataatatttaaggtggaaaagtttttgtgggttagttttgtgttaggatgttttggggtgagtgtgaaagtgtgtatattttagtttatagattaggtgggtttgtaagggaaaagttgaaggttattttttttttttttttttttattttttaataagttaggaatttgtaagatagtttgatgtagagatgtggggattttggtaatttagatataaattagttagagatttttgagttttagagaggtagttttttaatgttaaatattattgtttagtattatggggttatagtgttgagggttttagggatgatttatttaatgggggtttaggggtttttttttgggtgggtttttgaggttttatagattatgatatttaatatttttagggtagtatttgtttgattttagtttttagaggagtggggaaagtggagttggtggtttttagattgaagttttaagtttgtagtagttatgggggtttttatgtttttattttttttttttttttttttttttttttttttaaatggagttttgttttgttatttaggttggagtgtagtggtgtgattttggtttattgtaatttttgttttttgggttgaagtgatttttttgttttagttttttgagtagttgggattataggtgtatgttattatgtttggttaatttttgtatttttagtagagatggggttttattatgttggttaggttggttttaaatttttgattttatgatttgtttgttttagttttttaaagtgttgggattataggtgtgagttattgtgtttggtttttatgttttttttaatattttaaaaagtttgaaagaaattttatattttgtttgtgttaaggttttatagattaatttaatgatgaaatggtttttttttgttattatttagtgtgtaattttttgtagtttagaagttgtgattagtaattagatgtgtttttgattagtaaaaatgatgaaagaaagttattattgaagtgtttttaattttatagatagttttttaaagtgtgaagtttgttggaggagatgataattgggggttttggggatgaatagtttgggaattattagttggagatatagtgttatgaggttttatagttttgttatggattttatgagtttttatatttttatttgggggttagtgggggagaggagagtaggggattgagggattatggagggtgggttggattaggagagtttttttagagatatggtttttgaaaataaggatttaagttatttttaaatttttggttttttttggaagaagtttgtggttaatttaggtttttgatttttaatttttgttgtttgtagtgatgatgtagttattgtgattatttgattattaatgagtttgtttaattatttattgttatatttttaaaataaattttttttttttttgttttttttattttgtttttttggattaaagtttttttttagataaaaggagataggagagatttgtagttttaataattgattggtgagttataaggaggaggtataggagggaagaggtggtaggaggtggggagtttggttggttaaggaagtttttgttgggaaggtgggttttttaaagggtgttggtagagaggttttaggtttttgttttttgtttagtttggtgtaggtttgtgggatgttgtagagtttagtgttttagtttttgtttttttgggggttttagggatttttatttttttattttaagaggatagaattaatgagttatggggagggagtgaagagtatgtttttatatgtatgagtttatattttagatgtagtatttgatgtagtgttggttgagttgttggaagtaattatattgtttagtattagatttaaaagaatgaaatatgatattggttattggttggattaggtgtgttgggtagggttttttaggggtggtttttttttagtttttattttattttgtttatgggtggggtgtgttgagtttattgggtggttggttttgaatgtttagtttgaagttgggggtatagggtatttgaggaagataagtaatgtggttagttggttagggttatggggtagggaggtattgggaggggtaggtagttggttattagaatagatgtttgttttttttgtgttgtggttttagttgtatttgagatagttatagattttagaaggggagttagttgggtaggtaggggttataagtgttgtttgttaaaagaattttatttgtttgattgtgaggtgggggtggggaggatggagtaggagtgggatggtggttataggggatattgtatttgtttagttgtagatatttatagggaagttgaatttggatttttattttgagttgagtagaaggttttgggggtgttgatagtgagggttggggatgtggagaatggtattttttattgttgtttagaggttagtgttttttttatattttggagtagtttttgttttttatagggaatataggtttttttttatttttatttttgtttgtaatttttatattttttttttgttttagagtgttatttttaggttgagggagatagagttgagggtagaggggaggtaggggtatggtaattttttatttatttggtggtatttatatgtgaatatattaaaggaaaatttaggttattgtatttattttattggtggaaggaagatgatttgtgaaaaggtgaagagagtatgggaaatttttattttaaatagagagagatatatagatagatatataaaggtttagataaatttatatataaagatatttagagagatgtgggttgtgattgagagagagagagaggtgtggagattatgttgtattaggtagatgggagttttggagtttgggagagagggagataggtgtagatgtatttggggatgttttagaaataaaggggtttgggtgtttgttgtgttttttatattttttttggtttttgtttttttatttagttttggtttatttatggtataagggtatgaggatggatggatgggggttttatttatttaatgttaagagatgttggggagtataggtgaggaggtgaggggttttagggttttaggttattttagaatttttttaagttaaggggagttttttttttttgtttttgtttttgttttttttttttttaagtttagtagaaatatatatatatatatatatatattatggtagaaagttttgttagagatagggagggaggggtgtttgggtttttttttatgttgttgtttattattgagatttgttgaggttttgtttggtagttgtagatattaggtgggtgtagggttgagatgtttgttgtttattttgggtttttggatgttggtatggggtagtggagtagttagtgaggtttttttgagagttaagtttggggaggttgggtgttaatttttatttggtattatttggggaggatgatgttgaggttttgggaggttttagggtggggatagttttttttatttatggggttgaagtggtttgttttatgtttgttttaaaggtagatatgtttttggggagaaggaggtgaggaggggggtgggagttttttttttttgtttttggttttagtgtttagttttttgtagttgtaaggttaaggttaagtatgatttagagagaggtggaaagattattgattagttatttgtttttttttattttttttttttttttttagtttttgtaggtgtttttttttttgttgttgggtttttttttttttttggtgttgttgatatttgtggaagttttttattattatatttataaatatgtttaggataaagaaggttataatgagtaggaatgagatgaagtatagtagtatttaggggttgtggtttatgatgggttggtggggagtaggaaggataggtggaggtattagtttgagggtaagttgttttaggagttgtttatagtttgggtttttgtgaatttaaatagttatagttgtttgataggtgatggaaatgaatggtgtgggtttgatgtgaagtagtagggaggggtggggattgtggtaaaggggagagtagattttttatttaaaattgtttttttgttttggttgatttttgttttgagggaatgtaagtttagtttttttagatttttagattttttttgagtagatataaatttgaatttttgtgtaaaatttattattattttttttttttttagagatagggttttgttttattgtttaggttggagtgtagtggtgtgattatagtttattgtagttttaaatttttgggtttaagagatttttttattttagttgggattttagatgatattattatatttggttaattgtttttattttttgtagagttgggggttttgttatgatgtttaggttggtttttaatttttggttttaagtgatttttttgtttaggttttttaatgtattggtattataggtgtgagttattgtatatagtttaaatttattagtttaaaaatatttattattaatttaaaatatgttaaatatgttgtagattaataaaatatgtttagatttggtttataggttattagtaatagtttttgttgtaaaatatgatgttttttttatggtattttgttattttgttttgttttttttgttttggaattagtttatgttgagtgatttgagtttatagatggattttgtttattttagttttatttgttggtttatgtttatagtatttagtttattgtatatgatgtttatttaattatttttggaggttaaaatgaatagggatattagggtttgatggggaggaggagaaggagatatttgaagtttaggatgtgtggttgaattatttattatttgtttttaaagtgttttttgtattagttttaagtattttagtttttgaggggttaagttggagttatattttaggttttaggagagtttttttttttagggttttataattgagttgtagttggaggggttttgagagatggttatattttttgttttttgttaggtaggagaagggatataaaaattttggaaatttagaaattaaaattagagtgggtttgggaattaaaattgagtgagtaattttattttttgtatttttgtttttgtaaatatggagtgaggaaaggaattattttgataatatatttgttttttttattatgttaaagaaatatatatattattttattgtatttttattgtgatttttgaggagattttattatgattttatttattagttaatgaaattgaggttttggtaagttagttgttttaggttattgagttgataatggtggggttaggatttgtataggatttatatttagggttgtttgtttttattgttatgtgtgttttttgttttattatgtagttttgtggttttgggtaagttttttattttttttgagtttttgtttttttatttttaaggatggttagagattttatgggtttattttttggggtattgtgggatggattgggttttgtgatatgttggtggttagatagtagagggtgtgaagggttgatttttttgtggagtttatttttattggagttagtaggtattattaagtatggttttgtgttttttttagttttttttattatagttttatttttgagtttggggtttatttggttaaggttgttaaagttgtatttgtgttggatttattggtaattggttttggtatagtttgatttattggtgatgtttttggtatttttgttttggtatatgaaaaatttttttttgaagagttggatatatatttttagagatagagaaaagtgagttgtgattataggaagtttaggatttttgagttttatttttatgttagtttgggtatattttgagtgagtgtggggtgttttgttttggggttagttaagttagggaaatattgataagagttttttttgttgatattttttttttttttaagagtggggaggaaaggtaattggggtgggtagtgggaaagggtggaggtgggtaatagttatttattttttattaatggttaggttaggtgtgtgttaagtgggagtttttagtattatttgggaatatgttagaaatatatttttttaggtttagtttagatttgttgaattatatattttgaggtgggggagtagtgattttttaataagttgttttggtgattttgatgtaaatttaagtttgagaattattgagttgggtatttaatttttatagtagttttgggtgggggagtgggtattattaattttattttatagataagaataatggaggtttagagaagttaatttatttattaaggttttatagttagtaggtagtagaaagggagtttgaatttaggtttgtttgattggaaagtttatttttattttattataaattaggttatgattattagtgaaaaatggaaggtaggattagggggtttgagtaaattgtttaaaatagatttaaatttattggaaggattgggtttaataatgttttattttattgatttaaggaggttgggaagtgaggaaggggaagggtattgggtgggagtggggagggtgtatagagaggtattatatagttttggtaaatgtattttagtttgttttttagggttagagaatttttaggaagttagggaatagtttttaatttagggtagagtggatattttaggaagttaagggaatgaggggtggggaggggagggtgtagttatttaggggtttttatgttgtttgaatagttagttgtttattttgtagttgaaatagttggagttaagggttttggaagattatgatggaggggttttttggttttttgaggtgtttgttgaattttgtaggtagttttggtttttttttttttaaagttaagttttttttttgggtttaaggttaagtttttttagtagtttttattttttgttttgtttggggtttgtatttgtttgtttgttagtatgttgttaatttggtttagttgtttgggttttggatttttagatttggtttgtagtttattgtgtttgagttgggaaggaagggaggggattttggagtagattgtgggttagtgtttgtgtttagggagtgtgtgtagagggtaggaatagtagtttgtggtttttatggtttgaagttttttggtagttttggttttttttggggtttttttttaggtttttatttttttttgaaatgtttaggaggtaaaagggtttagagtttggagggaagtgtttttgtttatttttttttggaatgaaggtagtaatagtagtttgagttataggatttaggggttaaggggaagggttttttttaggtttttatttatagttggtttttagaattttatatatttgtatttttaagatgttgaaaatgatgaagaaggtatagtagatgattataatgttgttgatgggttttagtgaggatattagtgtttttattattagttttagtttttgtgtttggttgattattttggggaggggagggagggaggtgataaggttttttttagtttagatttttttttgttttttgattttgttttttatttttaattttgattattggtttttttttggtttttggtggtagaatataagttttttttttatgggatttttgttattaggatttttattgtaattttttaaaataagtggtagagatttttatgttttatatttttatttttattttaggatgttaaatgtatgatttgtttgggttgggagtggggaggatttaatttaagtgaggtgttttttagagatgtagtgtattgtgggttgggggtattaggagataaatttgtaggggagtaggtagagaggggaaggggtagagggagatggattattatagttagggaagtattgttattagtttatattatttttattaaaaaaaaaaaatttgagttgggggtggtgattggttgattggaaagggatttttgagagggtggatttttggttaggagaaatgttattggggggtggttattggtaggtgtttgaagatggggaaagttagtaagaggagtttgttattttatggggaggggttgagtgttatttttagaggttatataagggagagttgtagttgaagattgtgagagttttgtttgtggttttttgtgttgtgtgttgtatagggttgtagttattttatattatatggtgtagtggttttgaggaatatgttatgttgaagaggaggaaagtaggtgtgtatttggagggaaattattgtggttgtaatttgagtgttgtttggggtggggataggattgtttgtgggggttatagataggatgttggtttgtgtaggtttttgttttgtggtagggagtgttggtggtgggagatgtttttgtggagggggttattttttggaggtgttttagtgttggggagggagttatttgagtgggtgtagggtttgtagtagttgtagtatttttagtatgtttaggattttggtgttgttgttagagattatggatattagaatgttgatgatggagatgagtattaatagtttgtttagtatgttttaattgttttgtaggtatgtttgttttttgaagtattagtttagtgttattatttggggattattgttatgttattggttgttttttttgtgttgtagttaatttttttatttttagtttaagttgtttttatttttattaggaattagaggttttaagttaatattagtttttattatttttattgttattttagttagaaagattgtggtgaagatgtaattggagagggttaggaagatgtgtttttgtaagagaggggaggtaggggttgtttgttaggaagtttttatttttgggttaggtttgttttgtatatataagttaaaatttgtttttaatatttgatttagaaaatgatttttattttttataataatgtagattatgttttttttatatatgtatagagttagtgttaggttttttgatttttttgtagttttgtggatagttatatttttgtttgtgattagagttttttgtttttatagttatttagtttaagggggagaggatttgtattgtagtgttgtgatttgtgttttatgttttaagttttattttttggttttttttaaaaattggggtaggattttatttgatttttgatttttgtttgttattttattttttttatttgtttttttgttgtgtattttagaaatggagtagtagtggaagttggggttttgatatagattttgtatttttaggtataggttggggtagggtagggaggaaggttatttagttttttggtatttgtggattgagtttttttttgggtggttaggaggtaggtgtagatttttagagaggtggtgggtagggtgtgagtatagagaggagggaaggagaggagtaggtatagtgatagagttggagatggagaagttgagtgggaagatggtgagagagatgtggagatagtgatatggtgatagagagttttatagtagggttttaggtgggaggtagttaaggttggagtgtagttagtgtttttgttttattttgtgattttgggtgtgaggtttttagtgtgggtgtttttttatttgtttagttttgggttgtttttgttattttttaggttttttttattttgattttaatagaaaatagaagttttagtagtgttgaaatttaaataatggtgtgggagatggtaaagagggatgagaggtaaattttggttatttttaagtaagtggtgtaggatgttgtgagtggaaatataattattttttatttatttttttggaattagaattgttgttgatagtgaagggttataatgttaggttaggaagagatagtttttagggtgagttgggtttattttgaaggggtttgattttggggtggtatgtttagggtttttggttttttttttgagaaggattgataggtttgtagttaagtagaagtgatttatgtttttattatggtttttgaaaatttatttggttttgatttggaaggatgattaggagtaaagaatggtttttatggttattttgtatgtttttgaggttttgaggtagattgggtaagatgtttttttatttgtatatagtttttgtattgttttagtattttttgatttatgtgtgtgttttataaggttttggtttatgagaaatagtttggaatgagataaagtatttagttgggttgatgtattatagaagggaaattgaggtaggagaggatatagggggtattttggggattaggatttggtgagagatttaaaggagagttttggtttttttgttttttgttgtgtgatttgtaggttagtaattgtggtttttttgttttttttattggttttgagtgtaaattttaggagaggttttgttttgagtggggttggtgatttatagtgttgtgggggttaattttggggtgttttatggtgatggtgatgtagttaaggaagatgatgataaggattatgtggttgaatattttgtgggtgatgatttggtgatataggaggtggaatttgtttaggtatggaggtaatggttgagagggggaggtagggtaggtggtaatgagaggtattgtttgtagtttttgtttttttagtgtttttttagttgaggttattttgtttatattttaggtagggtgttattttttaaatttttgatagtattattagtggtaattttttgtgagaagaagaggttgggatataggttagatttttgttttgttatttatttggattgaggagggaagatgtaggttgattaggagttttgtttgaggtagtaggtagggagttgggtttggatttatgtgtggatttgtttttttttgttttgtagaataaatattggagtatgagtaggattaggtttttaggttttttggtttttggttttttagtagagttatgagttttattttttgtttatttttttttatttggggtttaagttttgttttgtttttttttttttatttttaaagttatttttttatttttttgttaattttgttaggttttttttttatttttgaggattttttgtttttttattttttttttttttttttttgtatttttaattttgtttttttttttttttatttttgtttttagtttagttttttgtttgttttttttgttgagttgggaagtagtattagttattaaatattggttttatatagttgtttgtttagagatatattttagttgaggagatattggttttgttttttatatgttaattttgaggttattgtattttatttttagggggaatggtggtgatgaggggttggggtaggggtatatgggtatggatagagtgggaagttatggtttgtgatgaggttgagatgagaaagggggatgtggggtattagtttggagagatgagtgatgggtttttttgagttatagggggagggttatgaaagatttatatatatttgtttaaaattatttatatttattaagggtggtagagttgtagttttaggtataggtatgataaggatttggggtttggtaaggtgggtagagggagaaaagggattgtttggagtttggtttttaggtgttttttgatattttgtgggtttggaatggtaatttttttatattttgttaggttaggtatatttttttttttttaaggttaggggtgaggggttattgtgtttataggggttttattaggttgtttttgttattggtgttatttttatttagtggggggttattaggttgtagggtttgggttaggtgttttgaagttgatttgttattgtagttttggtgtttagaagtagatttttggttattggtagtgtgatgtagttttggtatttgtagtgtgtttggtaggttaaaggaatttttggttttttgttttagggattttttgtggtgatggttattgtttgtagggttggtttgttttttttttgagtttttttttttattttggtttttttggtttttttttgataatagggattgttgttttttatttgggtttttttgttttaggttgggtgtatggttgaggttgttttggttggagtgtttgttggtttagttgtttgtagtgttttaggggttgtgtggagagttgtgggtgttgggttgtgggtgagtaggggaggagtggttttaggtagggtttagtagttttgtttttttatgtgtatttggttttttgggagttttattggtattatattaagtgtagggatgtgagtaggagttttggattttgatgtttgggtttagattttggtttattttaattagttgtgtgatttggggtaagttattaagtttttttgtgtatttgtttttttatttgtaaattagatatggtaatagagtttattttttatttatttggtgagagaagtgttattattagttgagtggtagtatatataatggggtgaagaaatataatttaatagtaaaaaattaatttaatttaaaaaatgggtaaagggtttgaatagatattttttaaaaggagatatagggttgggtatggtggtttatatttgtaattttagtatattgggaggttgaggtgggtagattatttgaggttaggagtttgaaattagtttggttaatgtggtgaaattttatttttattaaaaataaaaaaaattagttgggtatggtggtttatgtttgtaattttagttatttaggaggttgaggtaggataattatttgaatttggaaggtggaagttgtagtgaattgttgtgttttagtttgggtgatagagtgaaattttattttaaaaaaaaggagatatagatggttaataggtatatgaagaaatgtttaatgttattaattattagggaaatgtaaattaaaattataatgagttattttatatttgttggattggttattatgaaagtgatgaaagataataagtgttggtgaggatttgaagaaaagggaatttttgtgttttgttggtggaaatgtaaattaatatagttattatggaaaatggtatgtaggttttttaaaaatttaaaaatagagttgttatatgatttagtaattttagtattgggtatttatttaaaggatttgaaattagtatgtggatgagatatgggtatttttatttttattttagtattatttataatagttaatatatggaattaatttagtatttattaatggatgattggataaagaaaatatgggttaggtgtagtggtttatgtttgtaattttagtattttgggaggttaaggtaggtggattatttgaggttaggtatttgagattagtttggttaatatggtgaaattttatttttattaaaaatataaaaaattagttggatatggtggtatatgtttataattttagttaattaggtggttgaggtaggagaattatttgaatttgggaggtagaggttgtatgtagtgagttgagattgtgttattgtattttagtttgggtgatagagtggaaaggaaaagaaagaaagaaagaaagaaaatatggtatatatgtattgtggaataatatttagttttaaaaaagaagattgttatttgtgataatatggatgaattggaggatattatattaagtgaaatatataaggtatagaaagataaataaatattatatgattttatttatatgtgaaatttaaaaaaattgaatttatagaagtagagagtggaatggtgattagtagaggttggggttgggagaggtaaggatgggattaatggggaaggtttagttaaaggatatgaagttttagttggataggaggaattaatttttgagatttattgtatagtatgatggttatagttaataataatgtaatgtatatttattttaaaattgttaagagtagatttttaaatgtttatgttataaaaaaaataagtatgtgaagtgatgtatatgttaattagtttgatgtaattattttataatgtatgtatatattaaaatattatattgtgttttataaatatatataattagtatttgttaattaaaagtgaaatttaaaaaaattaaaaataaataaaattatgagagtatgggtattaatattagttttttggattaaaatgttggttttgttatttttttttgtaatttgaggtttaggttttttttgtaaaatggggattattgtggtatttattttttagggttggtgtgaggattaaatgtatttagaatgttttggagtagtgtttagaatagtgtttggtatagagttagtatttagatgagggtttgttattattattatttagttttgaggaggtatggatattttatttttattttatagaagtagattagagtggtggtgttttgtttgaggttatttagttagggtatagaagaggttagtttaggttttgtttttagtttttaggttagggtttttattttggtttgtattattggtgtagattttttaggggtttgtttaggtatatttaggttttatttagtttatggggtaggggttgtgtttttggatttgtttgtttttatttttttttttttttgttttttttggaatattttttattattagggtatttatatgtattttttattggtgattttattttgtgggttgttttaggttttgttgatttgttgttgttggtgtggtgtgatgtagggtttagtgttttgtttaggtttgtgttggtgtttttgggtagtgatatgggtgtggtggttgtgtggatgatgagaggtggtagtaggtttttttgtagttttgggtgtttttttagggatattattgtatggggagagagggagagattttgagtttatatagggttggtttagggttaaaagttgtattttaggataggtatttataggttaagtatttttttttgtttttattattatttaggttgggtgagaagaaattgggttttgatttggatttgttggtatttttttagggtaggggagtagtggattattagggatttggttaggtttgggtggttgggatggattgggtttttttttttttatatatgtatattatatataggttataggaattagtaattatggtatgagatatgtatggtgtaggttagattttttaggtttggggtttgaggttttttagggttttattatttttgtttttttagttatattttagaaaaggttatagtttatgtgagtttatagtataattagtttggttgaatggttattaaggttggttggggagagaaggggtagttaggtggtaggtggtataggttagagggggttggggatttggggatttgagtgaagtggttattagagttttttttgtaaaagtttattggaggttttttgttttttttttatggttttttttttttgagttttagatttgaggattttggaaggaaattgaaagattttagatagaatagtttagtttgaggatgttattttagttttttggtgttttttttttattttttttaagttttggttttttttttggttttatttttatttttttttttgtttttgggatagttttttttttttttttagtaggttagtaggttttttagtaattatatatttttttttaagaagttattaaaaaatatttgattgttatttttgataaggatataaatattgggtaattggtattttaggggattatttttattaatttagtttatagttttaatgaggtttttaattattaagtgggatttttagggggttgtttgggatatgtagtattatggggttttataggaatgttggttttgttttgaattttggtgttggggtagggaatagtagagtataggtttattgtggggttagattgggagttagttttgatagtgttagttggatttaagtgggtgatgaaggggttaaaggtttagaggtgatttaaaatattggtatattttggtaagagttatattttatttttatattttttaaggatttgttttgagttgagatagtttgtggggtttttaataggggtttggggtaaggggtgaaggggtgggagatgggggagtatggtttatggttagattttgattttattgaagttggatgtttgggatttttttgggattttagtataggtatgtatatatggggtgttttatatatgtgtatatagaggattttaagttttttttttttttggtttatttattagtttggtagggatggagatggtgtttttggtgggttgatgggggtagaggtaaggaggtgttttttttttgtgtttttaagggggaagggatttaaaattgaagtaaattttataatattaatgattattatggttatgataggttgtatagtagtggagtgtgaatatgagtatagagatatggaggtggagtggaggggtatgggtatggggtatgggaggtatgttggtttatgattgtgtatttattttttgggagttgataggtagttgaatatagtttaattgtttatttgtatttttttgtttgttgattttttatagggaaagggggaggtaggggagggttgttggttataggtgtttggggtttttagatattggtagtgttgagagaggatgaagaaaaggaggggtgtaaattttatagtaggggaattgagagatatggggaatgggggggtagagaggggatagaatagttttttagaatttaattataggtttttaggttagaatgaatttgaagggtgagtgtagaggttaaaaagatggggataagggtaggtttttttataattttaataataatagttattatttattaagggtgtgtttggtatgggaaattgtttttttaatattagttggtttttttgtaaggtaggaagtgggttttaggattgttattttatataagagaaatttgagatttggagaagttgtggaaattgttttaaattatatagagtaagaggtggatttgggtttggaatttgagtttgtggtttagaatattattttttttttattggtttggaggtagtgggtttggggaatgggtaggaagtaaggaaaggaatggatgaaagttagagttaatatggagttaagttaggttttataatgttttatgtttttagtttaagtttttttagattagaatagatttagttgttttgtttgagatgggatgtgataagtaatgttgagatgatggttttgatgttatttagtattaattaatggttttatatagggtttgttgtttgtttatttaattaagtgtgtgaatgataaatatatagggatttagggtgttgttttttgtaagttaggaaattattagttaagtaggttgtgtttttggattatttttttttagtttttggtaaggtagtaaggttagtaggggggttatttttgaagttttttgttggggaagtttattaaaatgggggtagttattttttttgttaaggtgggttgttttatttgttaaaataaaaataaaaattttaggttattataatagtaaaattagatttttttgttagattgtggggttttttgaaattttatttaggagagggtaggtgttttggagttgtttaggttatgggtattgaaggatattttttagttttgtttattatatgtaggataggggagtaattggtttagttttttttatgggtattttggggttatagttattgtttatttttatggagaggggatgtttttaaagttttttttttattttattttaggtttgaagtattttagtttaagatattgtattttgagtgagattttttttgtaaaggttttgatattgtgaaggttggggagggtgtggttgtgtgggttttgttgagtttttatattggggtagttttaggtttttagtagggttagagtgattaggttgttttagggttaggttgtgtttatttttatattttggttttgttgttgtttagtaattaggttgtttagttgtatttaagttaataaggtgtttgttgaaagggttgagtgttggggagggggttatttgtgttgggtatttttagattgttttggtggttgagtggtagaggaggggaggggaataggtttgtggtgttttttatttttttttatagagttgtatgggaatttttttgagggaattgtggttggtaggagttgtttttagaaggggttagggggtttggtttttatttagtttttttttttatagattttgagtagtagtagagtgagtttattggtttttgtgggagtattgtggtgttttttaattttttaggttttagggaatttttaaattagtgttttattttagggagtatattggtgtttttttttttttttttgtaagaggtatagttattattaaagttttttttattagttgttttggttgttttataggagggaggaaatgtgataatggataattatagattgaaaagggtagtggggagaaagattagtgtgggatagatatgttgtattttattaatttagttggtttatagggaaaagtttttttttgaaagattgggaaagagttggaaaatagatttttgtttttttattgtgtgttaggtatttatagattaggttgtagtgggagtttttatttgggttatttagagagaattggattaagagtttttttagatttaatttggagtgtttttaggttgggttaaattgttttgtttgaagttttagtaagttggggtgggtttgggggtttgggtgggaagagaggtagagttgagggagaggagggggtgtagttttttgggtagaggttgtttgttgatatggtaagggtaggattaatgtaaattaatattaattgatgatgttgtttgtgatgaaggtgatggagtttgggttggaaataggatgtttatttttgttatgtttgtagttaattgggtttattttttattttgggtagtttagttttgttttggttttagtggtatttttatttgtttagttagagtttagataatttgtatataagttttttgtattttttggtttagaggggttttttttgggtgttttatagagtattgtgtttaggagtttagttgtattataggtagatatttatttggtttgtttttttggggaaggggtttagttaattttgaaggggatgtttatttggtagttaagttttggtggagggattttaaataattattttgtgttttatgtgatgaggggttgtatgagatttggagttttttgttttggtttattttggtttagtttaagaggttttttttgtgggattttttaggtttttaaagttggtaatagagggaggaggtttaagataggtagttaattggaagtgggattgttgtgggtagggtgaggtgggtagagtagtgggttatttttgtttggaagttttttattagaatggtgattagtaaattgaagagtatgtagttgttgaaggttatgagggtaatgaaataaagggttgtttaggatgatgtggaggttatattattgtagaggattttgttttagtttttttgggttaggatttgtgggtagaagataggaattagggtttatattaggggtatttgatggtttttgtttatgttttgttttgttatttttgtatttgaaagatagtgatgatggtttagagtaaggagttaaaatttttttggtttggtagggtgtttttattttgtttagaggtaaatttgtagttgaagagatgtatgtttaggatgttgtgggtataagggggttataagttagggattagagtttagtgttttttattttttaggtttttttgtttttagtttggttggttttttagttggtaaggtgttatgttgtttttatttgaagatgaagatgaagagtataagtagtatgtagaaggtggttatgttgtttatggtttttatgagtattattagttgttgttgtagtgttggtaggaagtgtattagttttagtatatgtattaggtggaaggtttgtagtattgataggttgtttttttgttggtttatgattttttatatgttgtaaagggggtaggtagtttgagttttttgtatttttattttttttttttatttttttggagaggatttagtagtatttaagggtttggttgggtgggtatgttgagagaaaatggggtataggtgggtttttagatttttaagtaggagtttttaagatagtgaggatttgggtgatagttttggttttttttgtttttttttttttgttagagattatattttggtagtagataattttttttttaaatttggttaatgtaattgtattaagttatggaatatttgttttgtttttttttaatgaaatttaaagttaattttaaaagtaataaagtggtttttttggttttaggttttgtggggatggagtatttttttaaggttttggaaattttaaagtaagttgttggtgtttgagatgatttttaagtattttttgagttgggtagttggttgggttttatattttttttaatttttttaaagttaattttatttttgtttattttaggtttgggtggggttaaggataagaggtagaagtggagagaggagattaaagaggggtttgggtaatgaagaggtgagtttaaggttaataggagtaaggtggggttaagagagagatggagggggtatggggatatagagagttttttatttaggaggagtggtaggttttgtggggttagtggggtttgattttagatttttttattttaggggaataggtggtatggtttttggttttaagttatttttgttattattttttaattgagagttagtgttggggggtagttatatttgatgattataatgatattattgaagatgttgtagggatttttgatgtagttaaagggattatatataagtagttttagtagtatttttagggtaaagaggttggtgaagatgatgttgttgatttttagggtgttggtaagttttttgggttgtagggtagggtgggatgtgaggtagttggtttattattgagttttttgatttagttttttaaatatgggatattagggagaggaggagtaggaatagtaagtttgtgtggaggggttgttggatgtttaggtttatggggaggattttgttttaaaggttttaggaggaaatgtatttaggggtaggggttttaggaaagggttatgtgaaatttatagttttagttttgggttttagatttaggggttataaatttaatgggaggtttgtggtgtgggttttgttttattttttgttgggagttgtatggtttattttgatttaggttataatgtaagtttagtgggtttaggttagtagtatgataatgttggtggatgttagagggtgattgttaaggttttataggtatatttggttgttaagttttatataatgttatatgtattttataattattttgtggatttggtagtttttttttggataatagttggttatttttgtttttttttagatatatatatatatatatatatatatatatatatatagagagagagagagagagaaaaatgtatgtatttttagttatatatatggtgataggtagaaggaagatatgtagatatttaggaagggttgttatagttgaggagatatttggagttttagtttgagtttgggatatttgggttaatttttagtttattttgttatttattttgtgatttttagtaagatttttaatttttttggttaaatgtgaaatattagaggtaattttttttatgttttttatttgagtttgggattgggattgaggatgtattttagagtttttagaaggatgaatgatgaattttgttttatttgttattttagtttattagtgattttgtttttaatatgaagtgtttagtaatgtattaggtattaaaggagttgtaaaaatatgttagttatatgttttgttttttaggagtttagtgtttgttagaaatatgttgtatatatataaaatggttgaataattataagaggttttaaatgttttagtgttaaaataaattatttaggtagtaagtttgggagtttaggggagaaaaggtgaggggtgaatatatagagaaaggtttagttgggagagaggtagtatttgaatgtttaagggtttgtggagtttttttagttaagggtttaggtggtgtggtatggggtggggggattatgagtaattttagtttggttttggttgaagaagggaggggtgtggttaggtagagggttggggaagtaagaagagatatggttggtttaatggattttattgtttatttgatggatgtttggataaattaggtgtttggtttggagggtagaggttaagtttatagtagttgtttaaaaagtatgggttaatgaaatatttaaatgaggtatttattttattagatatttttttttgttttttattgttttgttggttagttgtttaattaagtttgtagttaggtttgaggatatttaaatgtattttaatggttttagtttgtgtagttagtttggatgggaggtgaaaagatttggaataaggggtttttgattagtaggtgagtggtatttgggagttttggggataatagttatttagagagagataaatttttagattgtttaaaggtaggtttgggggtagagttagggttagtaggtaggtagatagttagttatgtagagggggagtggttgttgtgggggttagtatggtatggagtttgttgttttagtagattttaagtaagttgtagttttgtggattgtgagtgggggtattgttatttgatttggttagtttggttatatagggttattagtgtttttggtgtgagtatagtataggaggtggggtggggttaggattaatgtatataaagttttgggtttagattttatttggttaagtggatttttttattttgtatttttaagtttggtttgttagggagtgggagttggtaaatttttttttttgttattttgttatttgttgtgtttttgggttttggattagattaaaatgaatatggattgtataggtatgatgtttaaagttatagggtaggaagagttggggtggggtttaattttatatttttttgattttaagaatattagatagttaggatttagaattaagttatggtgatggtgaggggtttgtgaatttagatatatggtggattggatatataatgtgttttttaaaattatatttaaattaatagagttttaggaataaagattaatttgatgtgaagatatagttgaggtatgtttataatgggtaaattttatggtatataaattatatttttaaaaagttgttaaaaataaaaattaatgaaatgtttttttaaaagttgttgaaaatatagtagtttttgatgttatgtatttatttaattagtgaattttaaaagtttgattattattgtgtgtggagaaggagattgttttttttattttttgatgttatttatggggtttttaggagtttgtattgatggtttgtggatatgtgtatattttatttttttgtatattattgagaggtttatggagaaggatgatgttaggtttttgagaagtttgttgttttataaggtttgttttattgaattttgttaagggttgtgttagtaaaggttggaatttttgttttgtttagttaagtgattttaggtttggaaaagtagggtagtttgatgtaggtggaaaggggtttggtgtatttttttggttttgttttgttttttttagtttttttgtaatatttagggtaaatgttattttttttttagggttttggtattttttttagtgagttatggaaaaagagttttttttttttagatagttaggtttgtttaagttattaaattggaggttgggaatgatttgtgaatgtaggatgaggatatagagatataattttagtaataaagttgttttagggattagagttgtaattatggttgaaaaggggtaggggtggagttaatatttggtagtgtttattataggttaattaggttgaagatttttttgtgggattttattttttttttgtttataataaatgagggagggttgtgagttttttagatagtttgggaaattgaggttttgaggggtgtggtgttttgatggaggttatattatttttttggagaggtgtagagttaggtttgttgtgtttttttttatatttttgtttttaagattttttttataatattgtttttattatatatttagatagagtttatatagagagtatataaatttattaggttggagttagttattttttattggttatttttagttgtggaagtttttttttaggtttagtttgtattttttttgttgtttatagatgttaaggtttagtggaggttttggtgaaatgaggttaggtagtttgagtttattttatttagaggttttaggttttttgtttgtgttgatgttgattgtaaatttttattttttattttttaatatttttattttttttttttttggttgttattttgtagtagtgttaagttgtttagtattttttagtattggggttttttaagttttatagttgttttattaattagttttaaaagtgttttttgtgtgttaaatattggtgttagaaaggtgttattaattttgagattttttttttatgtgattttgggtaattttttttgttttttagatttttagtggttttttttgttaaatagggtaatattattttttgggaggttgttttatagaataaaggagtgaaaggttgtgagaaattttagttttagggttaagtttatagaaggtaggattgatatttgtaaggttgtaattaaatattatattgggggtaaaatttaggagttatgggagtttaattttggttgaggttagtgggttagtggggaggatagtttgggaggatgtttatggagggtgtttttagttggggatagtaagggaaggggtgtgtagggtatagtgtagaattaagaattaagttgtttgtttagattagagggtgagaggggttggtgggagagaaggttataaggttggtagggttaggtggaatagtttttttttgttttttttggataagtttttgtttattatgttgttattgaggttttgggggtgggtgggaagggaggaaggagatgtataaagtagtgtatgaagaagattaatttggttgtagtggtggtagtgtgtggatggtttggagggtagagatagaaattaattaggatattgtagtagtttaggtaggaggtttgagagttagttttggtagatagtgatgtgttttttgtagagagggtatgaggggttggataggttttgttagagttgagtagaggtttggattagttatttgtgttttgtttaagtttgattttagttagttgttattgttttagtttttatttgttttattgattttgaaatttttgtttttttgtttagattttttagtttattttatttttgtttttgatgggtttgtttgttgtttttatttatttaggataggggtatagataggttgtagtgaggtagtgagggttattgggttagtgggaggtaagtttttaaggaggtgtgggaagttagggaatattttggtggtaggaggttttttggaaattttataggttttattatgtagattatggttttggttttttttagtttttggaagttttttagtttggatttttttttttgtgtttttttgtttattgggtatattgttaggtgttatggtgtttttagggttttttaattagaggtagtgttaaggagaggttttagttatagttattgtttttttgtttttagggtaatattttttagagtttattttatgtttattttttttattagtatttttatttttatttttttattgttattggggtgtaggtgatatgatattttttagttttttgaagtttttaaaagtaaatatataagttaattaggtatagtatatttatggtgtttatttagttttaagatagttgatttaaggtttttgttatttaaaattttggagttatagttaggtatggtggtaggtgtttgtagttttagttattggggaggttggggtgggaggattgtttgagtttagaagttttaggttgtagtgagttatgattaagttattgtattttagtttagggggtagattaggattttattttttaaaataaataaataataaaatgttggagttgtagtttttgtgttttgtttatttgtatagtgtttagtttatggtgggttatagtaggttatataaaggttgtttttttgatgaagatttttaagagtttttgttttgtttagttttagtttaggtaagtgtttttgtttttttttttttttttgtggttttggaagtgttgagtattgttagagagaggtatgaatatgtgttgattggataagtgattttttgtgggtggtggttttatggttgttttatgtttttatttatagtttttggtttttttttttttaggtttttttttttttttaggagttgttttaatttttttggattttgtagtttttagttttattttttatttggttttttgttgtaggtttatatggggggttttatgttttttttttaaagagttttgtgttgtgtattttattgttttttttttttttttggaagggagttagttgtttttttatttgtattttgattttttgatgtgtttttttgttgtttttttgttattttttatttttgtttttggtttttttgggttttggtttattagttatgtttgtatttattatttttttaattttttttttttgtgtttaaaagtagaaagtttttgtgggattttagatttatttagttttgaattttgggttttatagttttagttttgtttagggattttttttttagttttttttttagtggatgttttagtagtagttgagttttttttggtttttttgattttgagtaattatttttttttttttttagtgtttattttattgtttttttttttttaggttagtattttttagagtttagtttaagtttgttttttttattagtatttttatttttatttttttggttgttattggggtgtagatgatattaaataatttttttaagtttttggttttttatttagagatttagagtttgtttgattttttttttgggatggtttatagttattttaaatttagtgtatttaaaataaatttttttgtttttttttttaaatttgtttttttttgggtggtgttattatgtttgggattttgttttagaaattttgggttatttaggatttttgtttattttttttttttttggatattaaggtgttttggtttagagaatttgttagtgaaattgtgttttatttataattttttgtttttatagttatggttttatttggggttttttttgtttttgatttgaataatagaaatagtttttaggtttttttttatttagtttgtattaatgggaagtattggtttttttgttgggttaatattaattattgtttagatattttggggttagggtagggaggaaaatttgattgttttttagagtattgagtgttattttgtgtatgtgttttaatttttttatttagatttttttgtttttatttatttttttattttttatttttttttatttttattatttaagttattgttaattttatttattttttgaggttttgtttaaaagttattatttttgtgaagtttttttgaaggagagttggggatgagtagtttttttttgttttttgaagttttttttgtggtatttggtataattatttatgaaatagaatgatttttttattagaatttatattttttgggtgtttttggtttagtttttaattttttgatattttaatattttattttagtgtgttgtgtataggatatgttttttttgtttgtagaattgggagagtttggagttaggggatgtttaaaagaataagagaatattttagtagatatttttaaaataatgttttttttttttttatattagatagtttttgaatgtttggggttagttagttgtaaaggattattttttaaagttttgtttggtttttagttttagttttttagttagggtttttttatttggagattaagggattggttggggtgggaggtgtttattaatttttgtttttaaaggttatatttagggtgtttaggtatatggggattttttggggagagggtttttagtttttagtagaattgaaaaggagtttatgattttttttaaagtttagatttattatatttggattatttttttttgttttatttttagttttttttgttttgaatagttaaatttatttatttataaatagaaattttttttggatatgtatttggagtgataggatggttttagagtgtgagtaatgagtagagttattatttgttttgtttttttttagtttgtaaggttatttattttggttttttttttttttttttttgtttatagtttaggagattattgggttatatgtagtttttttttttttatatgttgttgttttttttttagaatattagattagtatttgttttttattttattatgatttagagttaggaaggagatgttaggaagtttttgtgtttttaaggttttatttttgtatttttttttttttggagaggtttggttttagtgtagagttaggtaggatatagaagagaaggtaattttttttttgagttttgatagtttgttggatatggttaggatggtttgtaggtattttgtatgtaatatgttttttagtttatatttgtttaagttatattgtttttattttaggtagaaatttgggagttatttttgttgtttttttttaatttatgtttttaattgattgggttttgtagatttagttattagttagttttttttagttttttgttttttatttttagggatgaagatgtagtatgaattgtttggattattgttggagtttttatattgtgttttgttttttatttttattggttatgttttattttttttttagatttagtttagaggttattttttatatggagttttttttgaattttttttttggtttgggttaagggttttttttttatgtatttttttttgagtatgtgttatattaagtaaatatgattgtttatttgttgtgatttttttaaaaagaaggatagtgttttgggtttagtggtgtgttggagttgttttttattggtttgggagaattaattgtttatgtttttttttaattttatatttggtggaattgtgttggtagtttaaaattagttatggtgggagtatttatattatggaaattggtaaatgttatagattaggattttattattttagaagggttagttgttaattatttattagtaaattattgtttaggtttaattttagtgtaaaaggatgaattggaaaaaggttttggattttatgtattgttttgagtggatggggtatatatgtaggttggttttatattagattatattttgatattaggttatttttttgttttttttttagttttttgggtttttgttttttttattagttttttgggtaaatttaattttgttagtttttttttagttggtggttaaggggtggaggaagtaggagatagaggatagtatggggttagttttgggtggggtggggtattatatataggtgtttttttagttaggaggatggtggggtagtgtaggttggggggatgggataagtgaatgatgagttagttaggggatggtgggagaggatagggtttggggagggtagtggtgatggttaggagggagggtagggattttttttttggtaaagtattagtaatattttttttagtgtttgtttttttatttaattgattttgggattaatggatataattgttttattaagggtattgtagggaagttgtgagtttttttatgtagttagttttaggggagtttttgtttttttattttattttgtttttgtttttatttgtatttgggatttggtttttgtttttagttttttttttgtgtttttgtttttttgtgtgtttttgtggttttatttgtttttgtttgtttttgttgtggtttatttttttttttatatttttttttttttgtttgtgtgtttttttttttgttttttttttttgtttttattttgttttttgtgtttttgttttgtttttattagttttttttttgtttttttttgtgtttttatttttttatgtgtttttgtttttttttttgtgtttattttgtgtttttgttttagttttttatatttttttgttgttttttttggtaattttttatttttagtttgtttaggttttagggtttagatggtgggatgtttatgttgtagtgtttgtaagtatagggttatggtagtttttgggattttttattttttgtatttttgagtttgttggatagttgttagttatttgtttagtttgttggggatttttgtttatttttatggggtttttagtattaggtatgtggataaaattttttttggagtagatattgttgttattgagtgaggtttttttgttgttgaggatttagtgggagttttgggttgtttttgtttttttttaggagtttgagtaagaagaaggtgtaggtatttttgattgatggttgttgttttttttttaaaggggtgttttttttgatatttaattgaaagtttttttattaaggttttatttgttttgggtttgtgtgatttagtttttttttagtgtaattaaaatttttattagtagtattggttgggtagggattgttgggtgttttttttggggtagggagggggtattggggaggtgttttttgggggaggggtatttgattatggttggaataggggtgagggaaaggaggttgaggtttagggagtttgagtaatgggaggttaggggttgttattatttgggttttggaagtagaaaatgttgtttattttttattgttattaatttggtagagtggagtatttttttttgggaggttggtagagttggtatgtgtatatatatttatatttatgtagtttagatataatatgtttattgtggtgttaagtgtgtttatttgttggtattgtagttagggttttattttttttttattttatggttgtttggagggggttttgtggaggttagaggaagggatgttaatgtgtgatggtgatggggaggggtgtatttggttaggttgagtagttttgggtaaaagttgggtgtttgaaatattgtaggtgtagaggttagtggtgtgggggtgggttttgaattttttggaaaagtgaatattttattgtttgttttagatttggtttgatttgtgttttttagttttaatttagattttttagtatgtttgtattattttgtttgtattatttttttgagatgttttttttatagggtgttgtgttggtgtaagagttattttatattattggttttttttgtttttgtttttgattgggagggtgtggaggtggggaggtgtatggtttttgttttaaattagggaaggttgggttttgatggtttagtgtttttgtgttattttagggaggttagaatatttaggagaatagagtttgggaggattgtgaattgtagtatttgtttgttagtttttttttttttttaagaattagttataggggtgatttgaaaggttagattggggggagggggagtgatttttggaaagaattttgtggaagagggagttaaatttagttgtgaggatttatggtgtttgtttggatttttaataagtgggtatttttagtttatgatgggggattagtggggttttttaggttattttttttatttttgtatagttttgagggttagaaaagtttttttttttttagtttagattttattgtttgtagttattagttttataaaataagtttgtttttttttttatatgatagttttttaaatatttgaagatagtttgtttgtttttgttgagtttttgttttttttaattaaatattttggtttttagaattattttttaaatgtgatggttttaagtttttttgttatgttgggtatttttatttattttgagttgttttggtttatagtatggtttttagatgggaggttaggaaagattgtttttttttttgattttaataggtttttattttatttaggtgtaggtattaatttttttttttgtatttttgtttatatggttttttttgtttttaattagttatatttggatttagtgggttagatggatgttataggatttttaatatttgttttttgtattatattttttttaaagatttaaatattttttagtgatgtgtttttttttatatgttgatgtttattatttgtttatattttttaaagttagttttttttgagtagtttttttgggtagaatatattttgtggtttatttgaggtgatttttatatttagagattttaagtattttttttagagaatttttatgtattgttttattatttatttttttttttatttgttaggtgggttagtagtatggagaggaagttgagtttaggaggaggggtgtggagggaggtagaaggttttagttttaggtgaaaagtagttggtaggagttttgtttttgtttatttttttatttgtttgtggtatttgatgtttatgttgagtgtgttgattaggatggtgattatgattttttggttaaagtatttgttgtttataattttttggaaggtgttatagattagtttttagaaggttagtatagagttgggttttgtatttgggtttaggttttgttgttgttggttgtgggggttttggaggttgttgtgttgggtattttgtgtgaatttataaattgttttgttgtttgagttaggtattttatggttggtgagttttattttttttgttttggtttgggtatagtaggggtagttgtttggattataggttttattgtttgtttttaagtaagggttggagattttgtaagagttttggtaggtatttggaataggagagtagaggtgagaggttttagagttttgtatttggggttattttgttttgtgagtatgtgtaaaatgagttagggagtttggggttgttatagtgatggggtgttaggtatttagtgggttaggggtgttgaatgttaggtaaggtgggtagttttgatttataagatgttttaatgttaatagtattttattgatagttattgttgagtgttttggggtttagagaggtggtttggatgttttttgaggttttggatagtttttatattttaggtgtttttagtaaggagttttgtttttttttttttttttagaagttaggattatattaatattgttttgagtagtattttttatgggatttttaagatatgtttatatatgtgtatttgtatatatatttatattagatatgtgtatttgtatatgtgttttagatgtgtatatttgtgtatatatgtatattatttggatattattatatgggtatatatatatgtatatattaatatatgtgtgtataaatatatttatatatggtatatatgttagatatatgtatatatgtatatatattaaggaaagagttttatattgtatatgtatttatatatattaagtatatgtgtatatatatgtatatgaatattagatatgtgtatgtatatatgtatatatatatattggatttttttatggatatagatgtatatatgtatattagatgtatttgtgtgtatatatttagggatttagtttaagatattaatgtttttttaaatttagttttgattatagaatatgagaattttagagagtattaggtaaagtatggatgtggaagttttttgtttagggtttggttttaggtgggtttttagtgatattttttttttgattgtatttgtatataggagggagttagtaagtatttattgagagtaattatgggtttagttttgttttttatataggaggaaataaaaatgtgggtgtatgtgattggtttatgttttgtggtagggtagtggaggagttggtatagaaattttttgttttgggttttgtgatagtattttttggttttagtttatatttttatgtaatatttttatgaatattttgttgttttttatgtgttatattttttttgaaatataggttgtgggttgtagttatagtgaatttgtttgttggggagagtttgatgtttttatgtgttttattgtttttatgatattgggagtgttatttattagataagtagttttttgaattgggtttttttgtgtggaggtaatgagatttaggtttagttagtggggtatgaagttgggtatagttatatattattttttttttgagttttataataaggagttttgagtgtgggttttgagtttgttttttattaatagtaaagttttgggtaagttatgtaatttttttaagttttttggtttttatttatataatggggatgttaagaaagtttattatttaatgggtagagaggatttaatggaattttgtttgtaaagtatgtgataggtatatagttattgttgtgtgtaatagttgttagatattattgtaaatagtatgaagtaggtgtttattatatgatagttattgttattataatgtaggaattatgagttttattttagtagatgagaaaatttgagtttatagtagggatgtgattggttgaaggtgtttaagttatgagaggtagtatgagaatataagttttggtttttttgattttagattttttagttttttttgggatgttatttagtttttagatgagggtatttatatgtttttatttagagtttttatttgtattttgtgtttttagtagtttgtgtatggagttgtagggtttgggtgggatgttgaggttggtgagggttgggggtttagagttggtagttatttttattagtgtttttttttttagtgtttttggtggagggttggtgtgtatggtgggatatatttttttgttgtttatagttttgttggatgttttagatggggatttgggagggggtgtttggtagtggattggttttaagtggtagttggtatggtagaagttgtgtatagattttgtgttattagggggggttttggagagggtaggtgttgagggtggtggtagtatgagttggtgggatttattggtatttttgttttggatttttgggttggtttggggggttttgagtgttttattgtttaggtggtagtggtggtgatggtggtggtggtggtgtattaggtggtggatggataggtggtggtgggagtgagagtagttgttgttgggttgggttttttggtttttgaggggtgttgggttgttgagtagtttaatttgtatatttgttgtttgagagatttgagttagtttgtgggttgttttatgaaggatgtatattaggtatttgagtagttttttatagtagttgttgggtttagagaagttagttagggtgttggtgttggataggaattgtatatgttgtttttgtattagttggtttttttgttgtttggtttttgagaattgtgtggtaattattattaggtataggttgattatgaagaaggagtttatttgtaggggtggggataggaagaggaaatgttttgaagaaaagtgaattataatgttagttattatatatggaggtatttttatgagttaagtgttatgtttagttattttttaagtattattttattttatttttaagatagttttaggaggtgatgttattgtaatttttattagataggtaaggaaatttaggtttatagaggttaaatatttgtttaagattatttagttaatttagagtaaggttaagattggaattaagttttatgaaattttaagatattgttattgaatatggtgttattttgtaattttttaaattttttgtttttaaatatgtatatttgtagagatgtagtattttttttgtaatttttattaggagtagtgaatgttgtggaaatgaatgtaatattagggatatggggtttttaaattatattgagttttgagattttgataaaaatattatttataagatttttgtttttagttttaattttagttgtgtgattttgggtgagagatttttagttatgggattttatatttttatttgaaaatagggattattggttttgtttgtttttattttttttgtgttttttttttttagatgtgggaggggttgaatttttgattttatagattagttaggttgttatttgatttgtttatattattttagtttttatttttatgttttagtttttttagaattttggaatagttattgtttggataataattttaaatgaaggaaatgaatatttatggtgataaagtagattttttttttttagattgtgttttagtaattatgataattagttttattagtgtgattttagagagttgttaggaaagattttttagggggtgtgtgggagggtggaaattaggttttttatttttttgtttgttttttttttttttttttaagtttaggagggaaagggagtgggggtggggggggtatatggtgagaagattttatttttttgaagtattggttttattttttgaggtggtggttagggatgggaataggtttttagttaggttttgttttaagtttgtttatttttttgtattaggggaagttatgtaggtagaatgaggtggttttggggatttgtttttttttagggtttattttttgttttttataaggagttgttttattttgtttttatttttttttggagttagttttaggttttgagtagattttaattttttttaattttttttttttaatgtttgtttttttgtttggttttgttgttggttttttggtgatatggaagaaaggttgaatgtggagttgttagtttgggattgaatttttagttttagttgtttattttttgtgtgattttggtttagtgatttattttttggggtgttgaatttttatttaagagatggggattataatttttgttttggtattttataggggatgatgaggattaaataggtagtagatgttatagtatatgttagtagtgatgttttatttttggagattaatatatagtataggtaaagtgtttggtagggttagataaatgaggaaatgttagtttttttatttgtaaaatggagaggattatggtgaggattaaatgtattagtatattgaaagtgtttagattaggggttggtgtatagtaagtgtttaataaatattagtttaaagtggtggtgatgaagttattaattatgaatggtagtgattaaaattattaaatattgttgtttttgtttttgttttttgtttttttaaagtttggtaatttttgaattggtaggaataagagattaggtagtatttaatattaattgattattgattagaattttgggtagaataattttttatttgtaagtattttaggatgtttagtttttttttttttttttagtaataaattgttaattgtattttttttgtttttataaaaaaatagaattttgtaaatatgtttaaaaaattattggatttatttaaagggatgaattgaatgatatgtgagttatgttttaataaagttattaaaaaaaattaaaattagaattatttttttttatttttaaatgttttttgggagaggtggtattattttaggttgagaattatttattttatttatgaagaaatagaggtttagagtagtgttggaggttttatggagaatgatttgtttaaggttttaatagtagttaagttttgttttgattttggatttttttttgattttgtatttggtgttttttttattatatgatggatgttttttttataggatttgttttgagagttaaaaattttagatagagtaaattattttttttttggattgtttttataggtgtttttaggattgtttatttttatggggatttgaggagttatttatgatgatgaggaggatgaagtagatgaaattgtagaaggaatgagtatttattataaagtatatgatgttgatttagttttttagtgtgatgatttagggggtgtagaggggtaggttgattatgggtttattaaatttttttttagttttttttagaggttttgatttttattttaattttgagagtgattattttgattttgggttgtgttttggggttggtgttttggggaagtttttggggtttaggttgttttatttggaagatggtgatttaggtatagttaatgttgttaaagttgatggtgtttttgaaggggttgtgtttttttgttgagtagttggtgtagtattggttttagttgatataggtggtgttgttggagttgttgtaggttttatagtttagattgtaaggtgggttattgtttttgtttttgtgtagtgtgggtatgtttttgtaggattgtatgttgtttttgtgtggttgggagtagatgaaggggtttttatttttgttttttgtttggtaatagtgttttaggtttatgtttagggggttgtaggatgggaaggggaataggggtgagattggggagtgggttttttagggagagggtttaggaagggagagatggtatgagtgtttgaggtatatagggtgagtagggtagaattaagaatggggaagggattgggtagggtagggatttgtgggtattaggagtatgaggtttgagtggggaaattttagatttaggatgttggaaggttatattttggaatagtgatttttaaattttattgtaagttaggattattggaggggttgaaaaaatttttatatttaagttgagttttagagtaatgaaattagaatttttggaggtggtatttaggtattagtattttttaaaattttttaggtggttttaatgggtagttaagtttgagaattagatatgttttagatgttagaatagatatgttagtagtaattggaagtgaggaatttgggggggtgtttagttttataattatttttaggttttttttggattttgtttattatttataggttgaaatttttaggtaggaagtattggttttgaagtagttttgtttatagttggatgttgatgatgttgaagatgaagaagatgaagaagtagagtagtaggatgttgtttagtatgggtagtgtatttagtagtaatgtgataaggatgtgtatgtttgtgggggtagaagttatgttggggatattaggttggttgggttaggttgattgttatggtttggtagtatttttggaggggttttattagggattttgaggttgagatggtttggtttaagttggaggggagattaatagatatttttgattttttagatagtttttgtagttttttgttttgatttatttttttttgtggtttgtttatggtaatttgtatagtattattaatagtgagttggggaaattgtggttttttttaatttttttaatattattatatgtggataatattatttttaatttatagatgagaagtttgaggtttggagaaatgatttgatttatttagtattatatagttgttaagtgtaggtgttggaatttgaatttaggttttggtttttgaatttttttttaatatatatttatatttgtatatatttatatgtatattttttatttattttttttttttaataggtatagttatttgatttttttaagttattattattagagttattagggaaattgaggtagtgaattttaggaggaatgatagtaggtaggaattttattttgagagttagtttttaggtaggggttaagatgttttgtgttttattatggttttgagttttgtttttttgaaattattttttgtttggtttagatttttaaattaggatttgaagagatataatattgtttttttagaagtttattaatttataattttttttatagggaaagttattgaaattttttttttaaaagttttgttagggttatttttttttttttgtattttaggtttagaatttaattggtttaaatggtttgaattagtttttagtttgttaagtttttgttaagtagatagatttttaatggttggttttatttttaaagtgttatttatggttttttggtttttttagggtaaaagttgttaagtagtagttaattaatttttttggtgattgtagtgtttagttttgtttttgttagtttagtttttttatttagtttttttttttttttttttattttatttttttttagtttttttgtgttttaattgagattaattttttagggtttgtattaagggaattatattggtggttagatagaggtttataaatttgttagttattatttggggtgggagaggaggtgaggtatgttttttttttggagtttttgttaatattaatatattttgagttttagaggatatatttaatagttttgtttttttaggggtagtagtaatattatatatatatatatatatatatatatatatagagtgtagggggttgttgttatattaggtatataaataggtattgagttttagaaatatgtattttttgttaattattttatttttaggattatagtagggattatttgtagtttgtgtaggttggggagttgtaaagggggtttgagtaaagggagggggtagtatgtagggagaattagagttgttaaagttttgttggttttagaaattaatgtagtttaatttagataatgggtttggtagttattgtaatgggttggaagggggtgggaaggaggaaggggatagaggtggagggtgagatatggagtggttttgttttgagagaagttatgtttagtgtggttagtgtgttttattagtaagaattagattgtatgagaggttgttttggttagaaaaggttattagtattttgtgtttattttttgtttgttagtttttttagtttttatatttttatttttttggggggagtggttatttagttgaaggaagagggttatttgagatgtttttgagattttgatttaaagttaggttaaaatgaggtggggtttttttaggtaatttttatagtgttatatttaggagttttattttgttttagtaattttagttttttattgagtttttttttgatggggtttgtgaggggttaggtgaggatatagtagtagaggtggggtttgagagttttatatttttttttggggttttttttaggggttgagggttgaggggttatttattgggtatttggttaatggttttgagtggttgtagtatatggattgttttgatagttgagaagttgatgttttgtaggtttagtgagtattttagtattttgtagggaggggtttaaagggaggttttttgagtttgaggttatagtggggttaaaagaggttaatgaggaattttgttttaggggtagtaggatgatttttgattttttttttttttttattaagggattttgaagatttggttttttgtttggggggtaaggttattttgagataaggatagattgtttattagagaagggggtagaattaggaatagggttttggaatttagaatataggttatagtgttagaggtagggtagttttagatttttaggagatagttagggagaaagtggtgttgtaattgggttggagttgagaggttataggtttagaattttggttttggggaagggattgatttgatttattgtttttttattttagtttaggtttttattttgtgatgatgatgaaaaagttaagttggttttaagtgttttttaggtaatatttttttttaaagatgtttaaggttattatttttattattatttttatggtaaagaaggtaaagatgaagttattaaaggtttgatgtggggataagaggtggttgaaattgagatgtgggtgagggaatattttttagttttattttagtttttattagttgggttagggttttttgtagaggagtagagggtattaagattaagaggggttaatttttaatatatataatatatatatatatatatatatatatatatttatttgtaggatttggtagtgttgggagttataggtgatgtttttgtatggttggaatatgtttagggttatgtagttgagaaggatgattaatatgttgatgtgtttaaattaggtattggtagttaaggaaatagttggttaaggttggagttgaggttggttttttgattttgttttaatattttttttttgtttattttttggttttatttgaggttaagtaggtgtggtgttagggttttgatatatatgtagattagtttttagttttagattttttattagagaaggggagttttattttggttattttatttttttggatttagtttttttatttgtaaaggaagataagttataaatattttgattatttgtataagttatttggggaataaattgattatgtttgtggaaatgttagatattatgagtttgttgtagaatttgaattttattttttttattttatagggtagatgtgagaagtaaatgagatattgtatgtgaatgtgttatataaatttaaagttggattatgtttgttttatagtttattaagtatttttatataatgttatagttgatgtttataatagttttgtgaaatatttggggtagattatttttttttttagaatttgaggaagttgaggtttagaaatgttgaagttatgtgttgaaggttatttgagaaggtaggatgagatggtggtttttaagtttttgatttatgatagttttttttgtatattatagttgtttaggtaggtagaattgtttgttatgattgttttggtattaggtgtaaggtagatgtttatagttgtagtttttgttgttatagtattagagtttggggtttttttttttattattagttttttaattttttaatatttttaaatgattattaggtatatttatatatttaaatattgaggatttattatgtgttaggtattatgttgggtatagtttttaagttgtgtagagtggataatgtttatttttttttttaagaggttattgttgttattatatttgtttgtggtttttagtttagattagttaaaatagtaagtaggagagaggggttttttttaaattttgggtttttttatatagtggattttatggggtgatttatttttagtttattagtaggagaatgtataaaatggtttttggattttagaaggttttaggtattggatttatggttaaatgattaagtattttattttttttaaggaaaatatgagaagggtggggaagagtaaagaggttagaaaagattagagagtaggagattggggaaaggagattagagattttttggggaatggggatgggggaggtattgtggtagtttttggtatgatttattaagttagattttgtagggtttagagtaggtggaattttgtttttggaatgagaaggttttggttaggtatgaagaggttagtaggaatgtttaggaatttatggattttttttttagttggttttagttatagtttatttttgttttgatttttaagttatatgtttttttttatagtttatgaattttttaaatttttgatagtttttttttgttttttttttattatttaggttttttttttttagatttatatgtttgtttgttatttgtttgtggtattttgagagttttaatgtattgtagtttttttaatttttatttttttataagaataagagggtttaagaaaaaagttttaggtttttgggggtaggtagatgatagggaggaaataaaaagtgttttgtttttatggaattgtttttttgagtagagttggagtgtagtggatttttttttagaatgggggttagttaggggttattttggaaaaagggggataggaagggagttattatttggaaagggaaagatatagttatttttaagaattggtttgttttttttatgtaggttttttttttttttttgtagggaaaggggggtttggaaggagttttagtgagtgaatgtttttgtgtggaggtagtagatttttgaggaagaggggtttttaggatatttgtttggatttttttaatggtagagttttattgtgttagtaatttgtgtatttgttgattttttttgttgagttggggtttttgataggtaggggtattttgatatgtttttagattttttatggagtttgttgtagtgtttggtatggagtagatgattaatatttgggaagattgaatgaatgaatgaatgaattaattaattaataagtttttttgtttagaagttagatgtgtgtttttatttaggtttttttgttttgttttttttgatagaggtgaattgtttataattgggggaaggtatagaagtgattttatagaggagttgtttttttttttgtttttattttatttaggtttagattggaggttttttataggtaaagtttgtttttgaataattttatgtatagtttttgattatgttagtttttttttaagggttttttggtaatttagtttatttttaagtaatattttgtttattttgtatagttttttttttatgatatgtaagtataaatggatagggaagagattaaggtatatgataatttgggatattttgaatagaggaataattgatggggggggggttttttattttttttagagtagggtttgtttttttgggaatatggtagtatgttattgtgtgatgtttttttgttgttataatgataggaggatgtgttattaggtggtgtggatttgttgttatggtaattaaaaagattttttttatatgattttttttgattgaggttgttgttttgtttttatgtaggggaggagaattagggagatttataggttattaggttgggggaaaattatgtgatagatttttatggtaattaagggaatgggggatattggttgttatagtgattatgagagatttgtgtagttatatgtttattgttgttatggtgattgtttgggttggagtggattttaaagagggggtaggagaggggaggattttttttttttttataatttattattaaaagtagagaaaaaggaaatggtagagagaggaattttatttttatttttttttttttttttttttttgggagagagaattagagtatgttatttttataaatgagttttttgtgtggggttttatttagatagagtttttgtttagtttggtagttgtaagggtgaggaaagtagggagaggaggggggtggttgggatatttttaggggtataggggttttgggtatgggttgagaaggtaagtaggttttttagtggttttatttttatttaggagtttggaaatgtgagattaaggaatgttgaggagaaaatgggtttggatttaggagttttggttttttagtaaatgaggaggtagggggataggtttttgttttatttattttatagagaggtttttggtgtttattggatttggtaatttttagggtaatatgggatgtaggggttttgttttgttttaaagtttaaagggggatttttttagtagaattttttgttttattttataagtttatttttttgtggttttttttttattatgttttagtgtgtgggtgtagggggagagaggtttttagttgaattgaaaattgaagtttatagaaaggtagttggttttatttagagatagagatatgagatatagagatataagagagatggtttgttggaatttttggaaggggaaataggttagaaatttgatttaaatgtttgtgattttgtgtgtgtgtgtgtgtgtgtgtgtgtgtgtgtgtgtgtgtatgtttgtgtgtgagtagttgtgtttgttgttattttggttgaggtaggtagggtggggtgagtgttgggtgggagtaggtgagggtggggggggttgtgtggtgggggtaattttaggaatggttttaattggtattatgggtgatggggagttttttagtagagtggtggagtagagtgggtgggaaggaatgtgtgtgtgatttagaaggaaagtgggtttggggtagaaagtatgttaaggggtgatttggtttttttttaattttatttaattttttagttttagtttttttttttagaattttttttggtgagtttagggtttggaaattaaattggaggagggaattgatgaagagataggaagaatattttttttattattttttttgaggatagaaatggagaattttttttaggtaagagaaataggtagatttggggtattgggatagtgtggtaaggaaggttttagaaatttttgtgtttttatttttttagagggatatatttagatatatagagtgatgtatagttatttatttatatttatttttggaagttattagggtttttgttgtttaggttttttttttttttttttttttgatttttggtaggtttttttttttttttttggttttttttttatttttttttttttggtattttaaatgttagtttgtgatttttaaatgagaaaaagttgtgttgggttttgagtttggagaaatttttatataaatttttagatgtgatataatagttagagagggaatgtggaggaatttttttttgagaggggagtgtgtttttttatatttgtaggaatatatattggaaaggttagtatgtttttttttgatttgaggtaggggtgattgtttgttagtatttttgttttttatattaaagtttgtatttttgagttttttgttgtttttttttgtaatatatatatatatatatatatatatatatatatatattttttatttgggtttagattttttttttaggaaatttggttttttaaaaaggagaggttaagaagtagaatgtattaagaaaagtttaattagttttagttagttgggggtggaggggagtgtttttatgtttttttggtttagaggtgtatagggatttttttgaagtttgtggggagttatagatattataaagagaaagagggaggttttggaggtagtttagagtttttttggtagtaaaaatataggtgttttttggtatttgggtaggatggtagtggtgaggggtatagtttaggtagttttttgttaaaaaattgtttttaatttatttttagttaatttaggtttttttagatttagtaatgttgatgttatatatttaattattatttttttgggggaagttgttttttaatttttaaggtgagtgttgtttttttatttttttttttttatgttaggttttaatatttgtttttgtttagattatttagtgaaggagtttgtttttagattttttattagtatttggagatagggtaggtgagaagagatgttagtttagaggtttgtttttagggagaggggagagaagagttttttttattttttttgggatttttgagaaggaggatatagaggttgatgtttttttttatttgtggaaggggtaaatgattaggggtagagaggagagttgtttggaatttattttttttagttatattagttttttatttttatttttgtttgggagaaaggggtttggggttgggggtttaaattttaagattgtgtttatttagtaagaatatagatttttgaggtttgtatttttttttttgtagtttagagagaaaggaagaaggggtagtggatgagaagaggatgtgatgaggggagttttttaaagatttataaggtgtagaggatgggggtgggggggttataagtttatttttgttttgtgtattagaggtagtagagttgtagagagtgagggtggtattaattttttattttttttttttaaagtagagtttttgttaggtttataggggttataagggagatttggggttttttattttgggtttataagaatttttgagttggaaggaaggagtttagagaagttgtttagatttgagatggtagtaatattttttttttattttttttttttttggtggtaggatttgttagggagtttggggttaggtgtttgttaagtggtgttttgagttagggtttgattgggttggggttttttttattattttagtttgggtagatagggagtagtgttaaatttatttttttggaatgtggggtttgtattttttaaatttatttgtggagtttatgttggggtggtggatttgagttttttttagtgaatatattgatagtattattgtttttttaagatttttgtgggtttgtagttttttatatttggtttgtaggagtattttttatttgtgaaaggggaggagtaatttggattagtttaattttattttttatttgttaaaaaagtttttgatatagtttttttttttataagaaaaatttagtataaaattttttaatttaattttaagtattttgtattgaatggagattgggtaggaggtatttgtggtattgggttttagtggaaaggggttttatttttagttttgggggtagatagtttttttttattatattttgtttttattttgtgtttttgatattagttgttgttggaatttttttgttgtgtttttaatttgtgaggtggggggtgaggtgggttaggatttggtttttgttttttaatatttttttttaggttagtaaaaattttagttttaaggattaggttgggggattagattttagaatttgttgtaaattttggggtgggggaaggagggaaatttaggagattgtggtttttttttttttgtttttgtagttttttttttattgtttttatttattttttattaaatttggaaattaaatttagtttgttaattggtgtgggtagagtatagtttttaggtttttgaagttttttatatttggaggatgatgatttttttttgattatatttggagggtgtttagttgtgagttagtggggtatagttttttttttttggtttggatttttatttttttaatttaggaagattgaggtgtgtgtatgtaggtggggtaagtttgggttattgatgagatttgtttgtgtttttgtttttattttggtgtttttttttttttttggtagttttttttttatttgtttattttttgggtttattttgatttatttggtggtgggttttttttttttttgatttttggtggtgtggtttgttttttttttgattttgtgtttggttgttgtgttttgaaggatatgggttatagattgtgtggagatattagttttgtgggtggttgttttggtttaagtagaagaaaattattggggttagtgttgggtatggtagtttttttgttttggagtttgtgttgtttgggtttttttttgttgattttggttttggttggtttttggtttttgataggttgttgagttgtatgaagttttggggttgttttgattttttggtgtttgttttatttttttttttgtttattttttggttagttggggttttgggtgatttggagaggggtaagtggtgttttttagaggaggtgtttttatgtaatttgggggttttggtgggggtatatttggtgggttttagggtgtaagttgagtttttgggagggttagtttagtttagttttttttgtttgtaggggtatgttgtttgtggggtgttggggtgtagggaaattttgtttggtgtgagttttgttttttttgtgtttttggggttttttgggttagttggttggtttttttttattttgttttggtttttttgttttgtgtttaggttttggttgttggatttggtgttatttttggtgaagttgttttgagagggtgaatgaaaaggggggtagtggtggagggtgggggtttggggaggggtgttttttttttttgtggtgtagttggagttggatttaaggggttagtattgttttggttttgtgttaggtggtgggggaggggaggagggatttttttaggggtgggtttggagggggtgggggtggtttttttttttgttttgttgtgggtttattgtttgggaggggtggggagatagtggggggtagttttgggtgggagtggaggtggagatgttgttgttgtagttgttgtggtggttgttgttgttgtagttgttgttggtgttatagtttttttttttggttgagatgtggagtgagtgagtgaaagtggtggtgaggagttttgtgtatattatagttggattttttattttaattttaagttttggttttgtttttagatagttttgtagttaattgttggatgttgttggttttgagttgtgtgtttattggttgtttgttgtggtagtgtgggtgggagtgtagggagagaattatagttggaatttgatttttattttaaaatttaggattgttttttttttttttttttgtttttgggtttgtttttgaaggttggagttaattagattgttgtttagattgaatttatttttttattggttattggggtttttgggatttttttggagggagtttgaagaattagagtatttggtgtggggttttggtgtagggttgtaggttttaggtattttttgtttatgatttttgatttgggtagtagttggaggatggagtttagttttgggtgggtttggggaagaaaggagataggtggtatgggggtgagggttgttattagggggttttagagtgaaattttaggtttttatttggttaattttttattttggagttgagtttggttgtgggattgggggagggaaggagtggagttggatgttttgggggtggggttttaggttggaggggtttagttttggagaaatgggtggagtttgagaaaggttagggtaggtatggtttgggtgtggtttttataaattttttgggtttattggttatatttttgagttaattttgagattttgattttgattttgtaattttaatttgttggatttgattttatattgatgtttttgggttttatttttttgtttttagggattttttgaagggtgtggattttatgtaggggttttgtgtttgaatatgtggttttaggtaggttgtgttggattgtagagtttggatttttaggaggggttgtggagtagagtgaggatttttaagaaggaatttgtgggggttttgagtgtgtgggagggggtggaagtatagagttgggttttattgatttgatttttaaagtttttattattgttattttttaattttgtgttttagttttttttaagtttttatgtggtttagggaaagagtgtttgtggaattggaattttgtgggtttgttgtttttatttatttattttaattttattggtagtgggtttttgtgggtttgtgttttttatgtgtgtatatgtatgtgtagattttggtttttgttttgtttatttttttgagttttggggtttagttggttttagttttt

SEQ ID NO: 232 - DNA, 7836 bp, Artificial Sequence
  Chemically-Treated DNA
attgttttttttgatatgtataaggttttaattttaataggggatgttttattagaaattgagggtataagatattagggatttattttaggtatgttgtttttgtgttaagtgagttagattggttggttaatagagtgtttataggtttttgaaatttttttgggaaaaatagtataaatagtagtagagattttattgaagggtatagaaaatatatttttaattttgatagagtttataaatgatagtattgatatttttttaaataaatatttttgttaaggtatagtattattatgtgtttttagatgtttaagaggtagtgattttatgtttttttgaggtttagtagagttattaatgttaatagggtggttgatggggtttagatttgttattagataagttaatgagatatgttgttagatttatggttatataattaagtatttaaaaagatgtataataggtaattgtaatgagtttgttttgtatttagtaatagttttttttaaataaagaagatagtttttagtattaagaaggatgtttatatgtatgttttttatggagttttttttataaattgtttttattatatattaaaaggagtttagttttattgtgatttaggaggaagaaaataatagttagaatttagttattggttaattgttagatttaatatttattattttatttgttttttatagtaatgtttggaggtaggtattattgtagtttttaatttatagatggagaaattgaggtttggagagagttaagtaatttgtttatggttatatagttggtaaagggtaaatatagtttttgaatttaagtttgtatatttaatttagaggtatataatatagtaatgtatattttaaaatgatagtgttattattttttaaatttaaaggttagaataattaaaattataaatgttaaatagtagtgttttaaataaataggatttgtattttttggtttgatgattttagggttataaggagagattgaaaaaatagagatgaatttaaattttagggttttagttattggaatttagatattggtgtgggtatttttttttatggattttttaaaattatatggttttagagaggtttagagtggttttatatttttgtaaaaattagttatttatttttttattttattatataagggtagttatttttttgagttatttagttgtttaggtttgaaggtttttgtggtgtttgttaaaggttttggaatttatattggtgggtataaagttgttttttattatattttttgatttgtttagtaagtttgttagttgatgagttatataggtggtagtgttataggtttttttttgggtaatgattttgatttgtaggatggagaaagaagagaagatttgtgagtgagaggttgggagagaggttagttttatgggatttttatggtaaagttgttgtgttgaaaggtattaattaattttaagtgttttttttaaatataattattagagtagaaaattataaggttattagggaaaatgttatgattattttttatagatatttttaggggtgttagaaaatttaaggtgattttggatgattggttatggaatgtggagtagtaatagttaattttttttgtataaattaattaaaaattaaagtggaggtttatgatattggagtgaattatggttttatatttagttttatttataaaggattataaaatttatattttagttatgggtattaaatatttttttttaggaaaataaaaaattttttagttttatttggaagaggagtggagtttgtagtattaagttttagaggtgtttatttgttttttaggatttttgttttttttgtttgagtttggttaaagggattatttattatattttttgtttagttagtttagggttaaggttatttttaagtataggttttagatattatgaagtttgggatatagattagagtaatgattattatagtttagatttttggggaaaaataattttattttttaaatgattagtatatttagaagtaggatagaggagttttgatgatatttttgggggatttaaagtggtttttattttttggtatttttttaggtgatttttttttaatttgtgagttttgttttttttttttttatttgaagtttgagatattttttgttataaggaaagttattaatattagtttaaagagttattagagaggaattaaattatatgtattaagttataggaaggatgtaagaagggaaattaggaaggaaagggaggagtttagttggtattttggggtatgttaatatgagggtgatggtttttttttaagttgttggatatattttttttttttttaggtgttttaattttaattgtagtttgggggaatgtgtgaaatttgttgaagttttgtgtgtatgtgtttagtatgtaagtatttagattattgtattgtttagatttggggttgtttaggttgtagggaaaatatatattagatagtattatgtattagaatttgtttttatgggtagttatttagaaggttagattaggtaggggattttgggagtaggaggggtaggtaggagggtagtttatttatttattttttattaggagagtttagaggtgtagtgggttagggtaatgtagggaagggttggatggggaaggatgattttttttggtattttatatgttgtttagttttttatgtttgatagaggggtttttagggtagatgtaggggtaatatatgtttttgtttgagtagtgttggggttaggttaggggttggtttttgtttaggtttaaggtatatagggatgtggatttggggaagggtgttttttttggttttttgataatatgtatatttttatagatgttatatatttaaaggtttaaatttattttagatattgttttatttatttttattttttgtaagggttttatttttattttgtaaatgtgaaatgaaagttttttgtaggtgtgaaagaatgttgtatgtagattaataaggtggatttaaatttttaaaattttttgagatgtattatgtgtatttttgattttatttttattagttttaatttatttagtgttgggaggttttttagtattgtaagaataatttttatagtgagtgattttatatttttttattttattttttaagaatttttagaaatggagttttttgttatgtttaattatggtatttttagttgtagtgggatttttgttttttttggaggttgagaatagttgggttttaggttttggtgaataatatagtttgttggatttttggttagtgtgtttttttttattttttgggatttatttttttgtgtatgttgtggggagaggaggttttgtgttgagtgtttggggagttttatttggagtttttttttttttgtttttgttttagtttattggtttttatttgtatatagttttgtattagtgtagttagtaggaggtgtgttttgtttttattgagtgtggttgggtttgttgggttgttttttagggtagatttgtggaggggaagtaaatttagtgtaggttgtgagtttttgtttgtttttttttaggataagtagttaggttttttggtttttgtttttttttttgaggatgtggttagtgggagttttaggggatagggtataaggttagtgttttttttaggatttaggtattggtgtggtttttaaatagtggtgtgttggagttagtttgtataggtttgtgaaagttaatggttaaatttttaagaattttgtaagttgagtgtagttattattaaaaattaaatgtaaaaatttatagttagtgttgaatttgaaaatagttttagtttaatagatttatatgtgggtgagaaatagattaataggtaaaatattagatttaataataataaatttagtggtaaattatttaatagaataggatgtaatttattttttaaattatggttgaataggataaataggatggttatatatataaaagtttggttaaaagtaataaaagtattttgtgagatttagtgggttatataaaatttataataggttgggtgtggtggtttatggttgtaattttagtattttgggaggttgaggtaggtggattatttgaggttaggagtttgagattagtttggttaatatggtgaaattttatttttattaaaaatataaaaattagttgggtatggtggtgggtgtttgtaattttggttatttgggaggttgaggtaggagaattgtttgaatttaggagatggaagttgtagtgagttgatatggtgttattgtattttagtatggatgatagagtgagattttgttttaaaaaaattataatgaagaatattgtttaaatatttattattatttataaattgtgtattatatatttttatattaaaaaattatatatgtgtatgagtatatattttattttggttttttgttggtttttaagtatttagtatattatatttaagaggtatggaattgtttgatattagtgtggttttggttttaggttgttttatttgaatggtgttgtatggaggttgtttgtttgtaataggattaagatgttgagagttaggaagggggagaatttttggaagtttatgatatttttttgtaagggaagaatgagataaattatttgtgttagtttgaagttttaggagtttatagattttggtttttattttggttttttgttttgtttttaatgttttggttttgtggttttagattggttattatatttttttttttttttgtttttttattagtatagtggatttttgggaggtttagtgggtttgtagtatgtatagtttgatagagttggaggagtgattttagagggagagttgagtgggggaggttttagttttatttttttttttaaagttatatagatatatataaatttgttagttaggtttttgtggaggatatgtttttaggtttttgttatagaagttgattttataaggaaatttagagttgttttttttttttggggtttttgtatatattttggtgggaggggtgggatttatttatagagattatttttgtaattggaatttgagaaataaaagaattaattttagtgtttagtttaagttttgtttgttggtattttagttttttgtaggaattaagttttatttttaaattgggatttaagattttttttttttgtttttagagtttgtgattggggtttgtagtttagggttgtttgttttttagttgttgtgtttatttgttatttatttgttttgttttaggttttgaattaatttttttgggattgttgggttttagatgttgtttttgattgtattgtttgtggaaagttttttttgttttaggttttgtgtgtggtttttggggagtttgagtgttttgagattggtttaagtttgtgtgtagtgtgagagagtaagattggagtttgtagttgagtaggaagagtgagttgggggattgagattgtttgatttaatttagggtatgagtttggtataaattgtggattaatagagattatttgatgaagagattaatggagagagagggagaggaggaaagggagtgagaaaatgatgaatggagggagagggagggagagatatatatttgagttaggattttggggtttatttggtgggaggtggtttggattagaggtggtggtagtggtggtggtggtgtttagttagagttttgtggaagtggtggtgatatttgggttgggtagtgtttttgatgttttttagtgttagtgattgtttttatttttgttgttgtgggttgggaaagttttgttagtgtatagtaattaatgggtggaggggttttttgtttttgggttgtgttatttttatgtttttagaatttggaggatttagtaggattgttttatttgtatttgtattgaggttattgatggaaatggtgggggatggtgggggtattaataagtaatgtttttaaagtgagtgggaatttgagggtagtttgatgttatggtgaattttattttttagtttggtttggttttgaatttttgttttattttatttttggttttatgatttggtggaaagggtttaggattgtagggatttttttaattttgattttagatttttgtttaagtgagattttaaaggttaatgtttttaagggtgggttttgggtttaagaaatttgattttagtagttggtattatttatagagggttagggtttgtgggaaataagagatggagttgggagtaagaattttgttagataggagtttaattatagttggtttaatttttggttgtgtgattatgggtaagtaattttatagaggtttagtgtatttatttttgaaatggggattataattttattttgaaggaatattgtgagaaatagtttagtgtttgggttttagataggtagggatttataagagttttttggtttgtataggggattttgtaagatttttatggatattttttgaatttttatttttttggattgttttggggtattttttagatttattatatgtgtgaggagggggttgatgatttgttgggtttgaggggtgagttgtaaggtatagatgtggaagtttttatttagatttttggatttttttttttttattttgttatttattatttgtttgagttgtttgtatagttgtttttttgtttttggttgttgtttgttaagatgttttagagatattttattttggttttgtatttttatttttgtattttagttttttattaaagagtaggtaggtgtgatagtgttgtgtggtttttgtttagattaagtttatatttgtttttggttatatttatttatatatatttaaatttattattgttttttaatatgtgtttattttgaattatagatattaaaaaatagatattggttagaagagtattttgaggtgtttatttaaatgtgttttaagtttgtttttgagttttttgggtggttgtatttatatatttgtatgatgatgatttgtttgtattaaatttgtatatattatgaataggtgttttttattatatttaattatgtgtgattttaatagtttttatattttgtagaattgggttttagttttattgtgtttgagtgtttagtttagtagaggtagggattaaggtgtttgttgtttatagtgtttagagtggtaagaaagaagttttttagtgtttttattattttttggtggaatgtgtagtgtgtgatttgttgtagttggtttgggtgttgtttgtgtggtgagtgtagtagtggtattttggggttgtgggtggaggtaaggattttagtttgaggttttttgaggtagagtagaaattagtttttaggtgtgttgtttgtggtgtgagttatggaattttaggtattttggggttgtgtttgtatttttgtttttagtttttagaagtgttgaaattttttagtatgatatttttgttttgtgttatattttttttttttagggggttggtggtttttgtgtttaaaggaggtagtgggaatgtttaatttttaagatgtttttaattgatttttttttttttaattatagtgagggaataataatttggggttggggattgggtatttaagatttgttttttgtagggtttgttggtagggtggttataggatttgggattggaattg

SEQ ID NO: 233 - DNA, 7836 bp, Artificial Sequence
  Chemically-Treated DNA
tagttttagttttgggttttgtggttgttttgttggtggattttgtggagagtgagttttagatatttagtttttagttttgagttgttatttttttgttgtagttaagaaggaggagattaattaagggtattttagaagttaggtgtttttgttgttttttttgagtatggaggttattaattttttagggggaagagatgtagtgtgaggtaggggtgttgtgttaagaaattttgatgtttttggggattgaggataaaggtgtggatatgattttggggtatttggagttttgtgatttgtgttatggatggtatatttaggggttaatttttgttttgttttaaagaattttaagttagagtttttgtttttgtttatagttttgggatgttgttgttgtgtttattgtataggtagtgtttggattggttgtagtagattgtgtgttgtgtgttttattgggagatggtggagatgttgaaaagttttttttttgttattttggatgttgtgggtggtaagtgttttagtttttatttttgttgagttgaatgtttaggtatagtggaattgaaatttggttttgtgggatgtgagagttgttgaggttatgtgtaattgggtgtgatggagggtgtttgtttgtgatgtgtgtaggtttgatgtaagtaggttattgttgtgtgagtgtgtggatgtgattgtttgagagatttggaggtaggtttgggatatgtttgagtgaatattttaggatatttttttggttagtatttgttttttagtgtttgtgatttagagtgggtatatgttgggagatagtaatgggtttgggtgtgtgtaaatgagtgtgattggaagtgagtgtgagtttgatttaggtagggattatatagtattgttatatttgtttgttttttagtagaggattgaagtgtgggggtgggggtatggggttggaatagaatgtttttgggatattttggtaaatagtagttggaagtaaaggggtagttgtgtaaatggtttaggtaggtgatggatggtagggtaggaagggggaggtttagaggtttggatggaggtttttgtatttgtattttgtaatttattttttaggtttagtaggttattggttttttttttatatatgtaatggatttgaagagtattttgggatagtttggggagatggagatttggaaagtatttatggagattttatagaattttttgtgtggattaggaaatttttgtagatttttgtttatttgaggtttaggtgttgggttgttttttataatatttttttaagatgagattgtggtttttattttaaagatgagtatattgagtttttgtgaagttatttgtttatgattatataattaggaattgggttaattgtaattgaatttttgtttaataaagtttttgtttttagttttgttttttgttttttatgagttttggttttttgtgggtaatattagttattggagttagattttttgggtttagaatttatttttaggggtattaatttttaaaattttatttgggtaggggtttgggattagagttggaagagtttttataattttggattttttttgttaaattgtgaaattaggggtggagtggggtgagggtttaaaattaggttggattgagaggtgaaatttattatgatgttaaattgtttttaaatttttgtttattttaagggtgttatttgttggtgtttttattattttttattatttttattaatgattttaatgtaaatataagtgggatggttttgttggattttttaggttttggaagtatgagggtgatgtaatttaggggtaaaggatttttttgtttattggttgttgtgtattggtggaatttttttgatttatagtggtgggaataagagtagttgttggtgttgggaggtattagagatattgtttagtttaagtgttgttgttgtttttatagggttttggttggatgttgttgttgttgttgttattgtttttgatttaagttattttttgttaggtgagttttgagattttggtttaggtatatgtttttttttttttttttttttatttgttatttttttattttttttttttttttttttttttttttgttagtttttttattagatagtttttgttagtttgtgatttatattaggtttgtgttttaggttggattggatagttttaattttttggtttgttttttttgtttggttgtggattttagttttatttttttgtattgtatataggtttaggttagttttgggatatttaggttttttagggattgtgtatagagtttgaggtaagagaaattttttgtagatggtgtgattagggatggtgtttggagtttagtagttttagggaaattggtttagaatttggaatagagtggatgggtggtaaataggtatgatgattgagggataagtagttttaaattgtaagttttagttataggttttgggagtaaagagagaaagttttgggttttaatttaagagtaaaatttggtttttgtaggggattgaggtgttagtaggtggagtttaggttgagtattaaaattgatttttttattttttagattttaattgtagagataatttttgtggatagattttattttttttattaaggtgtatgtaaaagttttagaagaggaggatagttttgggtttttttatgggattagtttttgtgataggggtttgggagtatgttttttatagagatttggttaataggtttatatgtatttgtgtggttttggggagaagggtaggattgagattttttttatttagttttttttttaggattgtttttttagttttattagattgtgtatgttataggtttattgaattttttagaagtttattgtgttgatgaggaaataaaaaagaagagaaatataatgattagtttgaagttataaagttagagtgttagaagtaagatagaaaattaggataggagttaaggtttgtgggtttttagaattttgaattggtgtaggtggtttattttattttttttttgtagagaggtgttatgggtttttaaaagttttttttttttttggtttttagtattttggttttgttgtaggtaggtagtttttatgtagtattatttaggtaagatagtttgaagttagaattatattggtattagataattttatgttttttaagtgtggtgtattgaatgtttaaaaattgatagggggttggggtaaggtatgtatttatgtatatatataattttttgatataaaaatgtgtggtatataatttataagtagtgataaatatttagataatattttttattataatttttttgagatagagttttattttgttatttatgttggagtgtaatggtattgtgttggtttattgtaatttttattttttgggtttaagtaatttttttgttttagttttttaagtagttgggattataggtgtttattattatgtttggttaatttttgtatttttagtagagatagggttttattatgttggttaggttggttttaaatttttgattttaggtgatttatttgttttagttttttaaagtgttgagattatagttgtgagttattgtgtttggtttattataaattttatatagtttattgagttttataaaatgtttttgttgtttttagttaaatttttgtatgtgtagttattttatttattttatttagttatgatttgaaaaatgaattgtattttattttgttaaatagtttgttattaaatttgttattgttaaatttggtattttatttgttgatttattttttatttatatataaatttattaaattgaaattatttttaggtttagtattaattgtaagtttttgtatttaatttttaataatggttgtatttagtttgtaaaatttttgaaaatttaattattagtttttataagtttatataaattggttttagtatattattgtttagaggttatattagtgtttgggttttgaggaggatattggttttgtgttttgttttttaggatttttgttggttatatttttaggggaagaagtaaagattaggaagtttggttgtttattttggggaggggtaggtaggggtttatagtttgtattgagtttgttttttttttataggtttgttttggagagtagtttagtagatttggttatgtttagtgaggatgaagtgtgttttttgttggttgtattggtgtagaattatgtgtagatgaaggttagtgagttggagtaggagtaagagagagagggttttaggtgaggttttttaagtgtttagtatagggttttttttttttgtagtatatataggaaggtggattttgagaggtaggagagaatatattggttaggaatttaataggttgtgttgtttattgggatttggggtttagttgtttttagtttttaagggagatagaggttttattgtagttggaggtattgtggttagatataataaaaggttttgtttttgaaagtttttaggaaatgaaatggggaggtgtggaattgtttattgtgggaattgtttttgtagtattgggagattttttagtattggatgagttaagattagtaagggtgaagttagggatatatatagtatattttaggaagttttagaaatttggatttattttgttaatttgtatatgatatttttttatatttgtaaggagtttttattttatatttgtaaggtgaaggtgaggtttttgtaggggatggggatgggtagagtagtgtttgaggtaggtttgagtttttaaatgtgtggtatttgtggagatgtgtatgttgttaggaggttagggagagtatttttttttagatttatatttttgtgtattttgagtttgagtagagattagtttttggtttggttttagtattgtttaggtagaggtatgtgttgtttttgtatttgttttgagaatttttttgttaagtatgaaggattgaatagtatgtggaatgttagaaaagattatttttttttatttagtttttttttgtattgttttagtttattgtatttttgagtttttttaatgaaggatagataagtgagttgtttttttgtttgttttttttgtttttagggttttttgtttggtttaattttttaagtgattgtttatggggatagattttggtgtatggtattgtttggtatgtgttttttttgtagtttggatagttttagatttaagtggtgtggtaatttgagtatttgtatgttgggtatatatatgtaggattttaataagttttatatgtttttttaaattgtaattggggttggagtatttggaaagaaaagggatatgtttagtgatttggagagagattattgtttttatgttagtatgttttagaatgttaattaaattttttttttttttttttaatttttttttttgtattttttttataatttgatgtatgtggtttggtttttttttggtggttttttgggttggtattggtggttttttttgtggtagaggatgttttaaattttagatgggaggaaagagagtaggatttataggttggaagagaattatttgggaaaatattagaaaatgagggttgttttgagttttttagagatgttattagagtttttttgttttgtttttgaatgtgttgattatttgaggaataaaattatttttttttaaagatttgagttgtggtggttattgttttgatttatgttttaggttttatagtgtttaagatttatgtttagaaatagttttaattttaggttagttggatagaggatatggtgggtggtttttttgattaagtttaagtaggaagaataggggttttaaggagtaggtaagtatttttaggatttgatgttgtaaattttgttttttttttaggtaagattgaggaattttttatttttttaagaaagggtatttggtgtttgtgattggggtgtagattttatagttttttgtgaatggggttgggtgtgggattataatttattttagtgttataaatttttgttttgatttttagttaatttatataggaaagattggttgttattgttttatattttatagttagttatttagagttattttgggttttttgatatttttgggaatatttatggggagtgattatggtattttttttaatggttttgtgattttttgttttgataattgtgtttaggagaaatatttaaagttaattggtgttttttagtatagtaattttattatgaaggttttatggggttgattttttttttagttttttatttatagatttttttttttttttttattttgtaaattagaattattgtttagaagagagtttgtgatattgttatttgtgtgatttattggttggtaggtttgttgagtagattagggggtgtggtgaagaataattttgtgtttattaatgtgggttttaaagtttttggtaggtgttgtagggatttttaagtttgagtagttgaatgatttaagaaggtgattgtttttgtatgatgggatgggaagatgaatgattggtttttataggggtgtaaaattattttgagtttttttgagattatgtggttttaaaaaatttataagggaaggtatttatattagtatttgagttttagtagttaagattttagaatttggatttatttttgtttttttagtttttttttgtaattttgagattattagattaagaaatatagattttgtttatttagaatattgttgtttgatatttataattttgattattttagtttttgagtttgaaagataatgatattattattttagagtatatattattatgttgtgtatttttgaattaagtgtatagatttgagtttaagaattgtatttgttttttattagttatatgattatgaataggttatttaattttttttaagttttagtttttttatttgtaaattgagggttataatagtatttatttttaagtattattataaagagtaagtgaggtaatagatgttaagtttgataattaattagtaattaaattttagttgttatttttttttttttaggttataataaagttgaattttttttaatgtgtaatgaaagtaatttgtaggaaaggttttatggaagatatatatataggtattttttttgatattgaaaattattttttttgtttgaaaggaattattgttaaatgtagaataagtttattgtagttatttattgtgtatttttttaaatatttgattatgtaattataaatttgatagtatgttttattggtttatttggtagtaaatttaggttttgttagttattttattgatattggtggttttgttaaattttagggggatatgaaattattgttttttgggtatttggggatatatggtaatgttgtgttttgatagaagtatttgtttaaagaaatgttaatgttgttatttgtgaattttattaaaattaaaaatgtattttttatattttttaatggaatttttgttgttatttatgttattttttttaggagagttttaggggtttgtaagtattttgttgattaattaatttgatttatttagtataaagataatatgtttgggatggatttttagtgttttgtatttttagtttttagtgaagtattttttattggaattagggttttgtgtatgttaaagagaataat

SEQ ID NO: 234 - DNA, 10077 bp, Artificial Sequence
  Chemically-Treated DNA
ttatatttaggatttgttatttaatttgtagattttagtgtaaaataaaaatttaggattttttgtttaaaaagtattatggggttaggtatggtggtttatgtttgtaattttagtattttgggaggttgaggagggtggattatgaggttaggagattgagattattttggttaatatagtgaaattttgtttttattaaaaatataaaaaattagttgggtatagtagtatatatttgtagttttagttatttgggaggttgagttaggagaattatttaaatttaggaggtagaggttgtagtgagttaagattgtgttattgtattttagtttgggtaatagagtgagattttgttttaaaataaataaataaataaaaagtattttgatgtttaagttggtaatagtagagtatttttgtttttttattttttaatttaattattaggtttttttaagtgtatggttttgtgtgattgtatagatggtatgtttagaatgttggttttgtttatgtttttttttagttggtgatggttttattttttttttttgtttttagttgtttttttagatagatttttggagttttttggtagtaatttagttttagttatttttagaagtttttagggttttgtttagtaggtatttagtatagattttttaaggttttgggggaatttttattttaggttattatttatattttttttaaattaatgtatagttattgagttttatttggttaagttttaggaagggaggataagtggataaatgattattgttttttaggagtttagtttatagtagagtgaagatttgaataagagtaggattggataagaattttgttaatttagagaaaaataattatagtttattaggaaattgaattttataaaagagagagtataaagatgggtttttgtgaatgggtaagatttgattaatttgatgaggaaaggggtatttaaggaagaagttatggtatgggtaaaaatttagagataataaaatgtatggtatgttttagaattttgaattgtatagtttggttgaggtgtgtagatggtaaaatagtgggaaaaagttggaaggaaaatgtatagagaagagttataagggtaatagtgaagtgtttgtatttttttagtggaaatattgaggggattttaggttgtgatgtttaggttatttgggagtaaagggagaagattttttttttttggtttttatagtttgtttgaagagtgtaaagttttatgtttttgtaaaataggttgtatttagtttagattttggagttgatttagtttatgttttttgatttatagtttgttttgagttttgataaaggtttggtttttttttgtatttggaatgtggaggatttgtagtttgtggatttgtgttttagtgtttaagttggtgttgatgggggttgtggttttttgttatttattttttatgggttttgtggggggtgtggggatgtggggagagggttttagaataggattttggattgggagggaagggatattatttgggtatatttagtaggtatgattggaggtgaaaaaagagtgggttttattttttgatggttttgtttgttatttattttaagtttatgttatggatatttttaaatatatttaaaagtagagagaaaagtagaattataatttaagtttatattgtttagttttaatagttattttttttaagtttattttgttttagttaatttttttttattatttattttaaagtgggatgtgggtgttttgagggaggtggaggttttttagttggagagtgggtgtttgtatttttggaggttgaggtataattgggttgggagttgagtgtatattgagtaggggttgtgggggagtgggggtagggttggtggggtggggttagaagtttggtggggttgggggtgtttttttagtgatttaaggtgtgtagtgttgggtgtaaagtgttagtttttgttttgtgagtttagagtgtgtttgttgtgttgttgttgtttgtatttgttgttgttgttattgttattatgtttaattttgttggtatttggaagatgtgtagtagtgagaattttgatgagttgtttaaggtattgggtaagttggtgtagagggtgtgttttgatggggagatgtggtttggaggtgttttggttttggaagtgttttggttttggagggggtggaagttggggagtttaggtaggagggagtttttggggtaatagattgttttgttttttaggtgtattgggttttggagaagttggtagagattttggaatttatgtgtttagtgaatgtttgttgaatgtttggtgttttttttgatggtgtggattttattttgtgttagattatagtgaggagagattattggagagtaaggaggattagggatttaaatttggagatttaaatttgggattaggttttgttatgaatttattgtgtaatttgaggaaagttatttattttttttgtgttttagttttttattttgaaaataagggtgagggtagggaaatgagtggattaattttaaggtttttttttaaagttagggtatgattagtgtttgattggttttgagattggtggtgaggttttgtgatttaagtttgtggtgtattttgtgtaggtgtgaatgttatgttgaggaaagtggttgtagtggttgtgtttaagttgtatgtggagatttgttaggatggggattagttttatattaagatatttattatggtgtgtattattgagattaattttaaggttggagaaggttttgaggaggagattgtggatggatgtaagtgtagggtgaggttttagagttattatagtgtttttgtgtttttgtttggtgtttatggtttattgttgttggaggaatttgtgtttttttttgtagtttgtggtgtgttttttttgtagggtgtgtatattggttgtttgtagagggggtttgtgtattttagttgtttttggtttaagataaagtattatttttattttattttaattttatttttatgttgttttttggggtgttaatagttgtgtttaaagagtgggttttgggttgtgttgtgtttttagtagtggtttttgtagtggtttgtagtgttaagtgtaggtggtgtaggaggaggaggaggttgtaggagttgttaggttttttgttgtaggtgaagttgtagtttttgtattttttttttgttgtattttttgtgtttgtttgggtttttgggttgtttgggtatgttttggatatagttttagtagttttgatggttttgttatttttttttttttgtttttggtttggttttttaaaggaatggtggagtttttttaaaagtaaggtaggttttggttgggaaaatggattagttgtttttttttagtttttaagggtaagagtttttttttatttttttatgtattggtttagggatgaattggtggattgaagtaaggggttgtatatttgttttttgtatgggtaaaaattgtatttggttaattagatggaaaaataattattggtgttattatttatttaaaaagtgatagaatgtttttttttttttttttaattttttttttttaaagaaaaaagttgtaatattttagagagtgggaaattgttttttttattttttttgagtagtgtttggtttgattttggaatgggattttttgagtattgggtttggaaggataaagaaataaagttttttagaagtaggttgatttaggaggtaatttttggttttagaattgttatagtttggaaatgatttttatgtttggagggggtgggatttgaagtttaaattgtattgtagaaataaagagtaggatagtatagagtgaagggttgggagtttaagagaggaggtttggtaataggtagggtttagtttggggatatttaatgttggttattgttaggaagggtaattttgatttaaaaaaaaaaaattaaaggtttatataatagttgggagagtggggttttatgtattttttatttttttatattttgtttaatgaatgtgttttatgtgttagttaaaaattgattatgtgtatatttagttttggtttattttttagtttagttgtattatatttagttttgtgtagatattggggaaaaattttaggaaatttttttttttgttttttatttttaaaagtatgaagagtttttagattgatttgttttttaaattttttttaaagggatgtaattgggaaagtggtagtattttaatttttagagttaaagatattgaggtttattagtgtaggggtgtattaaatttgatgaggagtgaatagaaaggatgtttttattttaaaatttatgtagggaattgtgtttttgataggttgatgatagatgtggttataaatttggtgttttaattgttgttaaattttgtggttttgatgtgaaggtttttgtttttaaaatttaaattatgtttatttgaggttaggagtttgagattagtttggtgaaattttatttgtattaaatatattaaaaaaattagttgggtgtggtggtaggtatttgttattttagttatttaggaggttgagataggagaattgtttgaatttgggaggtggaggttgtaaggagttaagattgtgttattgtattttagtttgggtaatagagtgagattttattttaaaaaaaaaatgaataaaaataaataaaatttaaattgtttgaagggttagttaatttttatataaatgaattattttatgttttaaattttatttttagagatgtaaagtatgtttaaggttttgttgttttagtaagagattgtttgtgtgtgtttgtgagtgtgtgtgtgtgttatataaggtgtatttatattttataaaatttgtgattagtattttgaatttggattttataaggtttagtggagaagaatttgtggtttgttgatagggattatgtgttgattttttgtagagtaattattttttaatgtttattgttgtttttgtttttgttgttgagattttaattaatgttattaatggtttttttgtttgtagagtttagttatttgggagaatgagaataagatttattgtatgtaaattttttttgaaggggatggttttaaaatttattggatttgtgagttggttaatgatgaatttattttggtagggaatttttgattttgaaataattttgaagtttttttagagggggttttagatgggttttataaatatgttttttttatttggttgtttagagaaagatattatttgttttggattaaaattagagtagaaaatttgagatgatagtttaggttagaggaaattattgttaaatggttggtaggaaagaggagtggtttagaggatggaataggggttggagataggttggagtgtttgttattatttatattaatatattttagtggtggtgatatgttttaagttaagttttttttttattaggtttggaatgtttaggttttatgaggtttttatgtttatatggtagaagggatttttttttatttttatttttttttttgttggttggaaaaggttttagtaatttttattatattagtatttagaattttagagaatatttttagttgtgatttgtaaattttaatggtttttgggagttaggtaatgaatgttaatttgggaagtgtttgagtataatatagtgtggagagatgagtttttgtagaattaaaaaagataggtttttttttaaaagtatttagattttagtattttggggggttaaagtgggtggattatttgaggttgtaagtttgagattagtttgattaatatggagaaattttgtttttattaaaaatataaaattagttgggtgtggtggtatatgtttgtaattttagttatttgggaagttgaggtaggagatttatttgaatttaggaggtggaggttgtagtgagttgagatggtattattgtattttagtttgggtgatagagattttgtttttaaaaaaaaaaaagtatttagatgaaaatattttaaatatttgtttttagttaaataaaatttatttagtgaggttaaattagaaatttttataatttaagtatatatttttttttttttttttaggtagagaataaaggaaggttgagggtagaataattttttttgttttttttttgtgttataaaattgggttgggattggtggtttatatttgtaattttagtattttgggaggttgagtttaggagtttgagaatagtttgggtaatatagtgagatttttatttttataaaaaaaaaaaaaaaaaattagttgagtgtggtggtatatgtttgtagttttagttatttggaggttgaagtgggaggattatttgagtttaggagtttgaggttgtagtgaattgtgattatgttattgtattttagtttgggtaatagagttgagattttgttttaaaattaaaaataaaaaaaaaaataaaaaaattaattaagggttttgtaattattttttttttttagattagaaaagggaaagttgttttgggtaattaggaaattatattttttgttttttattaggtattttgttaatttttgttttattttagtgaatgttattttgaaatgttgtgaataggagattgtttgttgaagggtgttaggaaaggatttgtagtgtgatttgagtataggttttttttttttaagtttttttttttgttatataatgaggggttaagttgaagtttgatttttgaggttttttttagttttgaaattatatgtttattttgtaagaagattttaaattgagttattatttgaaatgagattgtttgatttttttttttttttttttgtttttttttggtatgatttaatatgttttttttttttatagagaaaggattggtttaatttgtaatttggttaatattgtttttagggaaaggatatttgttgggtttgggggagtaatttgaggttgagatatggaaatttaggagaaaaggtgtatatggtttattggtattagagatagtagagggagatgattttagagttttagaatgtagttgagggtttagtaggattggtttgttttgagaaagagtgattttattaatttttgtagtatatgagtagttggagttataggttaaattttgttagatggattttattatttttaaattttttttttttttaattttagttttatttttgtatttttttttggtatagtaaatatatatataagatttaaagggaaagggagtattaatttttggtattttggatttgaaatgtgggtttttgttttaagggttattattattaataaatttaaaatgtagagagatgtagtttttatataataagaggtaattattttagttaagttgaaataagtttttttagtgttaatagtaaattgtttttaggttataagttgtttttttttgaaaattgagtatatttttataaattattttggaatattttatagagagtttttgttgggaatttttaagtatagtttgtaggttgagaagggtgttttaaatgtggttggaaatgtggtgatttttttttatgttatgaagttatttgttagttggggagagttgttagttagtgagaatagtttttttagggtatagtgtttaatatttaaatgttggtagttatttgataatttatggttgtagaatttaaagaattatggaaaattaatatggttttgaggtgtttagatatttgtgaggtagatttatggtgggaaagttaagttttatattttttagtatgtagaattatttgtatttttttttaatagagaagaggttaggataaaggtgtttaggagtgggtataattgttagtttggttaggagatttttagtatgaaaagttagtggttgggtgtagtggtttatgtttgtaattttaatattttgggaggttgaggtaggtggattatttgaagttaggagtttgagattagtttggttaataaggtaaaattttatttttattaaaaatatttaaaaattagttgggtatggtggtgtatgtttgtaattttagttatttgggaggttgaggtaggagaattatttgaatttgggaggtagaggttgtagtgagttgatattatattattgtattttagtttgggtgatagagtaaggttgttttaaaaagaaaagaagttagtgatgggtatttgtttttttagttattaaggatttgaattatttttttgaagtatatgtgttaggataatgttttagtatatgttttttgagagtattttgtgattaattaagatggtagggtaagaatataaagattttaggatagttaaatgttttgtttagtggttttaatatttttgtaattttaggttattttaagaatttgaaagataaggattttttggtatataaatgtatatttgtaaataaatatatttatattaggtttatagattggggaatttttgttttttggtttttgtttttgttttttttttttttaatatatatattgttttttttgttttaattgtttgtgagaggtttaggagagtaggtttgtgagtaattgttagttttgggggaaagttgagatagtttatttgtgggtaatattattttaggggttagtagaaaaatgtttttttttatttgtgtaatgatttgtgttttttttatagtaaataaattaagagttatagaattttagttggaagagtttttgtgatgattattttgttaattttatttttttttttaatattagtttttgtttgttttttttttaaataggttatgagaggaaaatatttgtttttaagtttagttagttgtgagttgtaggggttaggtttggatgttaatgttgtgtttttgtagttgagattaattttttagtttgtaggtgatttgagtattatatatatagtattttagtttgttttttaggttagatgattgttttttggaaagtagttttattttttttttaaagtaaggaatagaattggttggtgagtgttgggttttatgattttagttgtttgagtttttttttattttgaagttatttgaaaagagatagagttattttagaaatgtttattgtgatatttttttttttttagtttaattttaaaattaaaatttttggtattttttatgttagtattttataggttttataagtaaaggaaaatggtatataatataattttatattttggttatttttttattaatagtgtttaagggggaaaaaatattttttaatgtttagtttgagtatatatataggaaattgaatgtttgttataaagagtttttaatagggtaataagtggttttattagtgatatgttttaaatatttttgtataggtatttgtattgattggttttttttttttttttttttgtagatgtttggtgttgatgatgtggtttgtattagaatttatgtttgagagtgaaggtagttggtttgtttttatttttaggaagggatgtaggtttttttgaggaatatgttatagttttgagttgttagtggattgttttttttttttattaatattaggtgattttgttttttttatgataatgttgtagtgttttttatttttattttttaggttttggtgttttttgtatttttagtgttttatagtttggtatttgtatggttttgaagttattaaattggttagatgtgttttaatttttttttttttttggtttgtttttttagttttaatgtgggagttattgtgtatttattgtttttagtattgtgttggtttgtgtggtatttttagttttggtttgttggttttggtgtggggttttgagtatatgttagtagttgtaagttgggtttttgtagattggttggatttagattgtagatttaggtgtg

SEQ ID NO: 235 - DNA, 10077 bp, Artificial Sequence
  Chemically-Treated DNA
tatatttggatttgtagtttggatttagttagtttgtgggagtttagtttgtaattgttgatgtatgtttaaagttttatattgaggttagtaggttaaagttgagagtattgtatagattaatatagtgttaaggatagtaggtatataataatttttatgttgaaattgaagaggtaaattaaaaaagggaaaaggttgagatatgtttaattagtttaatgattttgaaattgtgtaaatgttaaattatggagtattagggatataagaggtattaaggtttggggggtgggggtgggggatattataatattgttatggggaaaatgggattatttaatattggtaggggaaaagggtggtttattggtagtttagaattatgatatattttttaggggagtttgtatttttttttgaaagtaggagtaagttagttgtttttatttttggatataaattttggtgtagattatgttattggtgttaaatgtttgtagagaagaagaaaaggaaaattaattagtgtagatgtttgtgtaaaaatgtttaaagtatattattaataaggttatttattgttttgttaaaaattttttgtaatagatatttaattttttgtgtgtgtgtttaggttaagtattaagggatatttttttttttttaagtgttattggtaaagaggtaattagagtatagaattatgttatatattatttttttttgtttatggaatttgtaaaatgttgatataagaaatgttaggagttttggttttaaaattaaattgaaagggaaagaatgttataatggatatttttgaagtggttttgtttttttttaaatgattttaagatagaaagaagtttaggtagttggggttatgaggtttagtatttattagttagttttgttttttgttttggagaaggaatagaattgttttttaggaagtagttatttaatttgggagataggttgagatgttgtatatgtaatatttaagttatttgtaagttagaaaattggttttagttgtaaaagtatagtattggtatttaaatttagtttttgtagtttatagttggttaagtttgggggtaaatgttttttttttgtggtttgtttgggaaaggggtaggtaggggttggtgttgaggagaggggtggagttgataagatgattattgtaaaggtttttttagttaaaattttatggtttttagtttgtttgttgtagggaggatatgaattattgtatagatggaggaggatatttttttgttggtttttgaaatgatattgtttataagtaaattgttttaatttttttttaaaattagtaattatttataggtttgtttttttggattttttataggtagttagaatagggaaagtaatatgtatgttaaaaaaaaaaaaaataaaaataaaaattaagaaatagaaattttttagtttgtaaatttgatgtgagtatgtttgtttgtaaatgtatatttatgtgttagaaggtttttattttttagatttttaaagtggtttgaaattatagagatgttaaaattattaaatgaggtatttagttattttaggatttttatatttttattttgttattttagttggttatgagatgtttttagagaatatatgttaaaatattattttgatatgtgtgttttagggaaatagtttaagtttttagtgattgaggaagtagatgtttattattagttttttttttttttgagatggttttattttgttatttaggttggagtgtaatggtgtgatgttagtttattgtaatttttgttttttaggtttaagtgatttttttgttttagttttttaagtagttgggattataggtatatattattatgtttagttaatttttgggtatttttagtagagatggggttttattttgttggttaggttggttttgaatttttgattttaagtgatttatttgttttagttttttaaagtgttgggattataagtgtgagttattgtatttagttattagttttttatgttagggattttttgattagattggtagttatatttatttttggatatttttgttttagttttttttttattgggaagaaatgtaggtgattttgtatgttagggggtgtggggtttgatttttttattgtaagtttattttgtagatgtttggatgttttagaattatgttaattttttataattttttgagttttatagttatggattgttaaatggttgttagtatttgggtattgaatgttgtattttggagaaattatttttattagttgatagttttttttagttaataaatagttttatgatatgagaagaaattgttgtatttttaattatatttgaagtgttttttttagtttgtaaattatgtttagaggtttttgatagaaattttttgtagaatattttagagtggtttgtgggagtatatttagtttttaaaggaaggtaatttatagtttgggggtaatttattgttggtgttgggagagtttattttaatttaattagaataattgttttttgttatatagagattgtatttttttgtgttttagatttattaatgataataatttttgaaataaaagtttatattttagatttaaaatgttaagagttaatattttttttttttttgagttttgtatatatgtttgttgtgttagggaagaatgtagggatagaattgaagttgggaggagggaggatttgaaagtgatggggtttatttagtagaatttggtttgtgattttagttgtttgtatattatagaggttaataaaattatttttttttagagtaaattgattttattgaatttttagttatattttaaaattttaaaattatttttttttgttgtttttggtattagtaaattatatatgtttttttttttaaatttttatgttttagttttaaattgtttttttaagtttagtaagtattttttttttggaaataatattaattaggttgtaaattaagttagttttttttttgtgaaaggagaaagtatgttaaattatattagggaaggataagaggagagagagaaagattaagtagttttattttaagtaatagtttaatttagggtttttttgtagaataaatatgtaattttaaggttgagagggattttagggattagattttagtttaattttttattgtatagtaaggggaagagtttgggaagggaaggtttatgtttaggttatattgtaagtttttttttagtattttttagtaggtagttttttatttataatattttaaggtgatatttattaagatggagtagagattaataaaatatttaatggagaataaaggatataattttttggttatttaaaatagtttttttttttttggtttggaagaaaagggtggttgtaaaatttttaattagtttttttgtttttttttttgtttttaattttgagatagggttttagttttgttgtttaggttagagtgtagtggtatgattatagtttattgtagttttaaatttttgggtttaagtgatttttttattttagtttttgagtagttgagattataagtatgtgttattatatttagttaattttttttttttttttttgtagagataggggttttattatgttgtttaggttgtttttaaatttttgggtttagttttttaaagtgttgggattataggtgtgagttattaattttagtttagttttgtaatataaagggagagtgagggggattgttttgtttttagtttttttttgttttttatttaaaaaaaggggaggaagtgtgtgtttaaattatagaggtttttaatttggttttattaggtaagttttgtttggttaggagtaggtgtttaaaatgtttttgtttgaatatttttttttttttagagatagagtttttgttgtttaggttggagtgtagtggtgttattttagtttattgtaatttttgttttttgggtttaagtgaattttttgttttagttttttgagtagttgggattataggtatatgttattatgtttggttaattttgtatttttagtagagatggggtttttttatattgattaggttggttttaaatttgtaattttaggtgatttatttgttttggttttttagaatgttgggatttgaatatttttaaggaaaagtttattttttttagttttataggggtttatttttttatattgtgttatatttagatattttttaaattagtatttattgtttggtttttaaaggttattggagtttgtaaattatagttaaaaatgttttttaaggttttgagtgttgatgtgataaaaattattgaaattttttttagttagtaaaagggggaatgagaatgaaaaaaaattttttttgttatgtgagtgtggggattttatagagtttaagtattttaagtttgatgagaggggagtttggtttaaagtatgttattgttattgggatgtattagtgtggatagtggtaggtattttagtttgtttttagtttttattttattttttgagttattttttttttttgttaattatttaataatgattttttttgatttgaattgttattttgggttttttgttttaattttaatttagggtaaatggtgtttttttttgaatggttgagtgaggaggatatatttgtggggtttatttggggttttttttgggggaattttaggattattttagggttaagggttttttattaggataagtttattgttggttagtttatgggtttagtaggttttggggttgttttttttaagaagagtttgtgtgtagtggattttgtttttatttttttaagtggttaaattttgtaggtgggaaaattattagtgatattaattagagttttagtagtgggagtagggataataatgagtattgaaaaataattgttttgtagagaattaatatatggtttttgttagtaggttatagatttttttttgttgagttttataaagtttaaatttagagtgttggttatagattttatggggtataaatatattttgtataatatatatatatatttataagtatatataaataattttttattgaagtagtgaggttttaggtatgttttatatttttaggaataaaatttagagtatgaaatgatttatttatataaaaattagttaattttttaaataatttggattttatttatttttatttattttttttttgagatggagttttgttttgttgtttaggttggagtgtagtggtataattttggttttttataatttttattttttaggtttaagtaatttttttgttttagttttttgagtagttgggatgataggtgtttgttattatgtttagttaatttttttggtatatttagtatagatggggttttattaggttggttttgaatttttgattttaggtgaatataatttggattttaaaagtaagaatttttatattagaattataagatttgataatagttaagatattaagtttgtaattatatttgttattagtttattaggagtatgattttttgtatggattttgggataggaatgttttttttgtttattttttattagatttagtgtatttttgtattgataaattttggtgtttttggttttgagggttaaaatgttgttatttttttggttatatttttttagaaaaaatttaaaaagtaaattaatttgaaggttttttatgtttttggaggtgggaggtaaaaggagggattttttgaagtttttttttagtgtttgtataaagttaagtgtggtatagttgggttggggggtgggttagagttgaatgtgtatataattagtttttaattaatatatgggatatatttattaggtaaggtgtggggggatggggggtgtataaagttttatttttttggttgttgtgtgaatttttaattttttttttttaaattagaattattttttttggtagtagttaatattggatgtttttagattgagttttgtttattgttaagtttttttttttagatttttagttttttattttatgttgttttgttttttgtttttgtagtgtagtttaggttttagattttattttttttaagtgtggagattatttttaggttatgataattttggagttaaagattgttttttagattagtttgtttttggggggttttgtttttttgtttttttaagtttggtgtttagagagttttattttgagattagattaggtattgtttaggaaaggtgaaagaaataattttttattttttggaatgttatgatttttttttttaaaaaaaaaaaattggagaaggggagggagatattttgttattttttaaataagtggtagtattggtgattatttttttatttggttaattaaatgtaatttttgtttatgtaaaaaatgaatgtataattttttgttttaatttattggtttatttttgggttgatgtatggagaaataaaaaaaaatttttgtttttgaggattaagagagggtaattagtttatttttttagttagaatttgttttgtttttggaaagattttgttgtttttttaaggaattaggttgaaggtgggaagggagaggtgatggggttattgggattgttaaaattgtatttagagtgtatttaggtggtttagggatttgggtgggtgtgggggatatggtgggaaaggaatgtaagagttgtggttttatttgtgatagagaatttggtggtttttgtaatttttttttttttttgtgttgtttgtgtttggtgttgtaaattgttgtaaaagttattgttgggaatgtggtgtaatttagagtttgttttttaagtgtggttgttagtattttgggaggtagtgtagggatggggttgagatggaatgaaggtaatattttgttttgagttaggggtaattaggatgtataaattttttttgtaaatagttagtgtatatattttgtaaggaaggtgtgttataggttgtaaagggagatataggtttttttagtagtagtgggttatgggtattgagtggggatatggggatgttgtagtggttttggggttttattttgtatttgtgtttgtttatggttttttttttaaagttttttttgattttgaagttgattttagtggtgtgtattgtggtggatgttttgatgtagaattgatttttgttttggtggatttttatgtgtggtttggatgtagttgttatggttattttttttagtatggtgtttatatttgtgtagggtgtattataggtttgggttatggggttttgttgttagttttgggattggttgggtattggttatattttaattttagaaaggggttttaaaattgatttatttgtttttttgtttttgtttttgtttttgagatgagagattgaggtatagagagggtaagtgattttttttgagttgtatagtgaatttgtggtagagtttggttttaaatttgagtttttaaatttaagtttttgattttttttgttttttagtaatttttttttgttatgatttagtatgagataaagtttgtattattgaggagggtgttaaatatttagtaaatgtttgttgaatgtgtgggttttgggatttttattagtttttttgagatttggtgtgtttgggagataaggtgatttattgttttggggatttttttttgtttgggttttttaatttttattttttttaggattggggtatttttgggattagggtatttttgggttgtatttttttgttggggtgtgttttttgtattagtttatttagtgttttgagtagtttgttgaaatttttgttgttgtgtattttttaggtgttggtgaagttgggtatggtggtggtggtggtggtggtaggtatggatagtggtggtgtagtgggtatattttgagtttgtaaggtggagattggtgttttgtgtttagtgttgtgtgttttgagttattaggagagtgtttttaattttgttgggtttttggttttgttttgttggttttgtttttgtttttttgtagtttttatttggtatgtgtttaatttttagtttagttgtgttttagtttttagaggtgtgggtatttgttttttaattggggagtttttattttttttaggatatttatattttgttttaaaatgggtggtgggagagggttagttgaaataagatgggtttggaggggataattgttgaagttgggtggtgtggatttgggttatgattttatttttttttttatttttgaatatgtttgaaaatatttataatataaatttaaagtggatagtgagtggggttattaggggatgggatttattttttttttatttttggttgtatttattgggtgtgtttagatggtgtttttttttttttagtttgggattttattttgaaattttttttttgtatttttatgttttttataggatttatggggagtgagtggtaggaaattgtaatttttattaatattagtttgggtattgaggtgtgaatttatgagttgtgggttttttgtgttttgagtgtaggagggggttagatttttgttagggtttaggataaattgtgggttgagaggtatggattgaattagttttagaatttgggttaggtgtggtttgttttgtaaaagtgtgaggttttgtattttttgggtaggttgtgagggttaaggggaggaagttttttttttttgtttttaaataatttaaatattatgatttaaagtttttttggtgtttttattaagggagtataaatattttattattatttttgtagtttttttttgtatattttttttttagtttttttttattattttattatttgtatattttagttaaattgtataatttaggattttagaatgtgttatgtattttattatttttaagtttttgtttatgttatggttttttttttgaatgtttttttttttattgggttaattaaattttgtttatttatgaaagtttatttttatgtttttttttttgtgaaatttagttttttaataaattgtgattatttttttttgaattgataggatttttgtttggttttgtttttgtttaagtttttgttttgttataaattgaatttttggagggtagtgattgtttatttatttgttttttttttttaaggtttagttaggtggggtttgataattgtgtattgatttgaggaggatgtgagtggtggtttggggtgaagatttttttaggattttggggaatttgtgttgagtgtttattgaatagggttttggaaatttttggaggtggttggggttgggttgttgttaggaggttttgaggatttgtttaagaaagtagttgaggataggagaggggagtggggttattattagttggaaaggggtatgggtagggttggtattttggatgtgttgtttgtgtagttatatagggttatgtatttagaagggtttgatagttagattggaaaatggaaaagtaggaatgttttgttattgttagtttgaatgttagaatattttttgtttgtttgtttgttttgagatagagttttgttttgttgtttgagttggagtgtagtggtgtaattttggtttattgtaatttttgttttttgggtttaaatgatttttttggtttagttttttaagtagttgggattataggtgtgtgttattatgtttagttaattttttgtatttttagtagagatagggttttattgtgttagttaggatagttttgattttttgattttgtgatttgttttttttggttttttaaagtgttgggattataggtatgagttattgtgtttggttttataatattttttgaataaggagttttgaatttttattttgtattgggatttgtaaattaagtagtaggttttggatgtgg

SEQ ID NO: 236 - DNA, 85734 bp, Artificial Sequence
  Chemically-Treated DNA
taagagtttattgttttgtttttttttataatagggaagggggttagagagtttttataagtggaattgtttttaaatgataagattatttaattggggttttatttgttatattagagtaatggaggtttttagattgttgtatttttttttttatttatagtttttttttgtattattgggggttttgtatgtttgtggaaaattggagaaatgtttgtttgttaaagttttttttatttttttttttttttttttattatagttatttttttaagttagttttgggaggataaatttaaagaagaggtttgtataggttttggaatgaatttaggatatgtgggtatatatttttggggttttatgtgtttggaggtgaggtatggggtatattattttggttttgtgattttttattttgtgggaaagagtgtgggggatagttagagatgggttttttaagtatatagtttagggtaggtggttttggttttttagtttttaggatagaaaaggttttggaaaggataaaagagagagttaggtttaattaagagaagtagaagtggaagtagtttaggtgtgtgggtaagtatgttagtatttatttttggaagtgggttttaggatgtaaggtaagtaaatttagtgtggagtagaaagtggttggttgtattatttgtgagtaaaagttatggtgtgtaaatgataatagttaatgtgatgttatgttgttgttttggataaatgtagtttttttttttattttagtgatgttgttattatttttttgattgtatatataggatatttgggagttatttttggtgtttgttttttattttttattatttattagtaagttttattaattttattttttggatttatttttaatttagtttttttttttttatttaatttttttttattttttttttaatttttgtgttagttttttaattgaattttttgatgttttttgttttttttgtttatttttatagtaattagaatgattttagtaaaatagagttgattatgatatgttttagtttaagatttttgatgaattttttattgtttttaaaataaagtttaaattttttattgtggtttattaatttatttatgatttggttttaatttattagtgttatttttttatttttatattttttaagttttattttttttgaattttattttgttttttttatatttttaaatattttgtaaagatggggtttttttatgttgtttaggttggttttaaatttttggttttaagtgatttttgtgttttagttttttaaagtgttgggattataggtgtgagttattatatatatgtttttatttaggtatttttttgttttttgttattttattaattgtagtattgtattgtggttttaatttttatttttttgatgattaatgatgtttagtttattttttttttgaaatttttgtttggtttttatttgttttaagaagtaattgttttttttatagattaagtttttgtttttttttgtagttttatgataattaatatttatttttattttggttttaatttattaaagtatagttgttttatttttatttttatatttattgttattattataaatatatatatatatgattgtgtattttttgaaggtagaagtagtattatatttttttggtatttttagtaattagtatagatttgaaatataatttttatataataaatatgatgagtgaatgaatagttgtttaataaattaaagaatggatgaaggtaggtagttaggtataaggttttgtagataggtttggttgtgttaattaaatttttttttatgggtttttatatttagtaagtttatttttaaaaggataatgttgaagatataaatgtttataatgattatagtgatgatgggatttgagagaaaggtaaggtggaaggggtgaggttggaagttgaagtgttgtagggagttagtggtgttttggttgttatggagattaggagttttaaaatgtggaggtttttagtgttttggattaatgagtgttaggggataatgtgggtgttaattttgttattagttgggtttagtagttttagttagtttatttggaagttttttttgtattttttttttgtttattttgaggttttttattatagttttgtagtttggttttgttgttttatgtagtttgtgttggtgtagtgttttgagttttagttgttttgtttgtgtttttttttgttgtgtatttaagatattttgtatttgtttattggtgttttttgtaatttgtatttagttgaggttattggtgatgaagtgagtgtaagtttgattaaggtttgtggtagtgagaatgagtgttatgaggagtttgtggattagttgtagtaggtaatgtggtggtggtgttgtgtttgtggatggtgttggggttttagtgtttggtatgtgttagtatttgttaggtgttaggtgttgttttaggatttggggttgtagttgagaaatagtttattatgttgaagtgggtttgatattttagtggaaggatgttttatttatatatatatatgtgtaaatattatatatattatataatgtgtggtatatatttgtagtatttgtttatatttttttagatatatatgttatatattgtatatattaatgaatgattgtggtagattgttgaatagttgttttatggagaggataaagttaaaagttatttggttttggggtgtttttgtattataaattataattttgattgggttatttatgtgtagattttaggaagtgtgtttagtttttagaatagtaattttgtttttttatttgtataaggagaaaattagttgatttgtggtttttgtgttgagttggtttttgttggttatattattgaagatttttttaaatttgtgggtattttttttatatttgattttttattttggtgtgttttttgttttttagatttttttttttttttttttgttttgttttttatttgttttttaagtgatatgtattttatgttgttagttttagttatttttttatttaatatatttgttgaatgtttgttgggtgttatattttgttttaggtagtggggatttagtagtgaataaaaatgttagtgtttgggtatatttatatttatatatgtaatttgttttttgtagtttttaatttaattgaggtagatagatattaataaaatgaatatttatatagtatgtgagatatttataggattagttttgttgtttttatgggttataggttttttaaagtgtagttagagtttttggttgggattttgtattttgtgatttgtgggttattatatttattttgttaagattttagtttatttagttagattttgtttttgaattttagatttatatttttgttatttatatgagttagaatatatggagtattataaatttataaattttatgattagttatttagtttattggattttatttttttagtatttgttttataagtagttattatattagagtttgaattggtaaatagtgatttttttttttgaagaaaaaaagtaatatatattataaatttttttttttgatagagtttggttttgttgtttaggttggagtgtagtgatgtgattatagtttattgtagttttaatattaggggtttaattgattttttttttttagtatttggagtagttaggattataggtgtgtattagtatgtttagtttatttatttatttatttatttatttgagatggagttttattttgttatttaggttggagtgtatggtgtaattttagtttattgtaagttttattttttatatttatgttatttttttgttttagttttttgagtagttggtgtttgttattatatttggttaatttttttgtatttttagtagagatagggttttattgtgttagttaggatggttttgattttttgattttgtgatttgtttattttggttttttaaagtgttgggattataggtatgagttattatatttggtttaaatttttattttttaaaaattgtgagatggggttttattatgttgtttaggttggttttaaatttttggttttaattgatttttttattttagtttttttagatgttggtattataggtgtgagttattgtgtttggtttatattataaaaattttaatttagaagttgaaatttaatttaaatatttgaagttttaaaattgtagaaattttagaatgtagaaaagtttaaagagtgattttttatagaaatataattatgtggttgggtgtggtggtttatgtttataattttagtattttgggaggttgaggtgggtagattatgaggttagaagtttgagtttagtttgattaatatagtgaaattttgtttgtattaaaaatattaaaaattagttgggtgtggtggtgtgtgattgtaattttaggtatttgggaggttgagataggagaattgtatgaatttaggaggtggaggttgtaatgagttaagattgtattattgtattttagtttgggtgatagaatgagattttgttttaaaaaaaaaaaaaaaaaaagaaatataattatgtaaagataagttgattttataaattatggtatatttatattatggaatattataaagttgttaaaaagaatgaattatatttgtattgtagataaatatagttgttatttatttatttatttatttttttgaggtagagttttgttttgttgtttagtttggagtgtagtgttatgattttggtttattataatttttgttttttgggtttaagtgatttttttgttttagttttttgagtagttgggattatagatatgtattattatgtttggttaatttttgtatttttagtagagatggggttttattatgttggttaggttggtttttaatttttgattttaagtgatttgtttgttttagtattttaaagtgttaggattataagagtgtgttattgtgtttggtttgttatttattaatttagtaaaaaagttatagaataatgttaggataatttaattttttataatatatatgtatgggaaaaaagttgaaaatttttataataaaatgttaataatatttttatgggatatttaattttttttttgtatatttttatattgtttgaattttgtaatgtatatgaattaattttgtaattataaaaaaagaaattttgaaaagagtaggtatttgttattttatttttgtaatgttgttggttttttttttttttttttttttgagatagagttttgtattgttgtttgggttagagtgtagtggtatgattttagtttattgtaatttttgttttttgggtttatgtgatttttttgttttagttttttaagtagttgggattataggtatatattattatattaggttaattttttgtatttttagtaaagatagggttttattatgttggttagattggttttgaatttttgattttgtgatttatttgttttggttttttaaagtgttgggattatagatgtgagatattgtgtttagtaatgttgttgtttttatatttatatttttttttttttttttttttttgttatttgttttttgtttttttttatttgtttttagatgttattgttatgtgattatttgtataggatttagatttattttttttgggaggagtaataattattattttgtatgagtgtttgtattgtttgagttttttttttagataattttgttggtagttgattttttttaagtttatttatagaaatattttatggtttaatgattgagagtaaatgttttggaattatatattttgggtttaagttttggtttttatatatattatttataggattttgggtgatatttatttttataagttttagtttttttatttgtaaaatgtagataataataatatttattttataggttggttgttttgaggattaaatgagttaatatagtaaagtatttataatattgagtatttataatatggtaagtttttagtaagtgatagttggttttgttatttggattagatgttaatttttatatttagaaattagggttagagattgttagtagatttaaatagtaagatatataatatagaatatagtattttatatttgaggaattgttttaggttattgttttttgaaaaatattttttgattttaagaagatttagttatttttttttagttttttatatatttttatttatatgttattatagtgtttttaagagttgattttatttatttgtatttttgttaggttttttttgttaaattgtaaattttttaagagtagaaattatatttgatttatttttttaaatgtaaatggtaattatataataaattttttttttttaagatggggttttgtttttgttgtttaggttgtagtgtaatggtataattttaatttattgtaatttttgttttttgggtttaagtgatttttttgttttagtttattgaatagttgggattataagtgtttgttattatgtttgggtatataataaatttttattaaaagaatgattaaataaatttttgtgattttattaattttaggaatataataaggaatattgtttttttatataaattgtttttttttttttttaaaagaaatggggttagttgggtatggtggtttgtgtttgtaattttagtattttaggaggttgagatgagaggattatttgagtttaggagtttgagattttatttttataaaaaaatttaaaaattagttggatatggtggtgtatgtttgtaattttagttatttggaggttgaggtaggaggattttttgattttaggaatagtaggtaggagtgagttgtgattgtgttattgtattttaggttaagttataaagtaagattttagttttaaaaaataaataaataagaaaggaaaataagattgggtgtagtggtttataattgtaattttagtgttttgggaggttgaggtgagtagattatttgaggttaggagtttaagattagtttggttaatatggtgaaattttatttttattaaaaaatatataaaaaattagttgggtattatggtgggtatttgtaattttagttgttttagaggttgaggtaggagaattatttgaatttgggaggtagaggttttagtgagttaaggttatgttattgtattttagtttgggtaataagagtaaaattttgttttaaaaaagaaaaaaaaagaaagaaaggaaaagaaagaaatagggttttattgtgttgtttaggttgattttgtatttttaggtttaagtgatttttttgtttgttaagtagttgggattataggtgtatattattatgtttggttaatgtaaattattttttatattatttgtattagtgagttttttgttttttgttttgagaagtttgaattagaaaatatggattagaagtttggttggttgaatagttaattagtaattagttttgaggagtatgttgggtatttaagtggattttttgggtgtaagtattgtgatagagtttgggttataggtgtttgttagttattaatatttgtgaggggaggggaatgaaagaaggagtgagttatggaagaagttgaattgtgatgggggtttaataagttttgataaatgtagtatgttgttttgaagagagtattgtttgttaaagtttttttttttgggttaaaatggttaggtttttatatttttgttttttttagttataggatgtgggtgttgtagaaaggatatggttttaggtgatttttttttagtagtttaggtagattgtgaaggggttgtttgttgatgatgttttttgtagttagggagtaagtttttttttgaatgtggatttgggtggtattataggaagtgtgttaatttgtatttggtattttattgtttggatggtagttttttttattgtgaagttaggagataggtaattaagtttaagtttgttattggttttattatggaaatttttaaattatttttttttatgggttttagtttttagatttagtagtttagattagatggttggaatagttttttgattattttatgttttattggaagttttgattttggggtagggttgagtaaagttaagtaatggtaagtaattttattatatttttgtgtatttgattatttttttgttagatttgggagttttataagtagtggttggatgagtttgaaatgttggagagatatattatttaggtttaagtatgggttattgtggaaaatgagtgggttatgagttaggttggagtataggattttgagagttttgttaggttgtttttaggtgtgtataaagaatttttatatgtttgtttaatttttgggttgttgatattttattgtgtttgttttattgtttattttttaggttttttttggatatttggagagtaagttgtagatatgataatatgaatattattataaaagaatattttattattataaaatatttttgtatgtgtatttttaaaataaggatgtttttttatataattagtatataatttttataatttggaaattagtttttgtgtaatattaatttttgatttatagatatttgttaatttaaatagtagagagagattttttaaaagaaaatgatggatattgtaatgggaatatatgtgttattgtaaattgtgtgtatatttagggaggtaaaggaagataaaggtttttaaaggaaaagtgaggaggattatataatggttttgaagtaattatttttggttgaaaaattattaataagagtagtattagtttgagattaaataggtggttgttgggtagatttgtgtgtgtgtgtagggttgtaatgatttttgtgtgaggttgtgatttttgtggtgtgatatggtttgtttgtatttttatttaaattttattttgaattgtagtttttgtaatttttatgtgttatgggagggatttggtggaaggtattgaattatgggggtaggttttttttttgttatttttatgatagtgagtaagtttgatgagatttgatggttttataaagggtaatttttttgtatatatttttttgtttttgtttatgtaagatatgtttttgttttttttttattttttattatgattgtgaggtttttttagttatgtggaattgtgagtttattaaatttttttttttttataaattatatagttttgggtatttatttatagtagtatgaaaatggattaatataaggtattttttgtgataatttttgttattaggtatttatgtatggttttttttagtattatttgttagggttttttaatataagtgattttattttgatttagataatttttatattttatttaaattttattgattgttttattgtggtttttttttttttttaggtttaggattttgtttaggaagttatgttatatgtaattgttatgtttttttttgagatgtttttatttggaataattttttgatttttttttgttttttatttttttgatagtttttgattagatttatattttgtaggatggggatggttttgtttgatgtttttttatgattagatttaggtaaatattttgggtaataggattatataaagttattttttgtttattttattgtagtatagtaggagggttatgtgatgttaatttttattttttgagtaggttggtgtttgttaggattttttgtattaaattttttaaattaaattataattgattagtattttatagagaggtatttttagattatattaatattttgttttttattaaagttttattgttatattattagtatttattgaaaattttttttttaatgtagaagtttaaagagtgattttttagaaatataattatgtaaagataagttgattttattaattatggtatatttatattatggaatattgtaaagttgtttaaaagaatgaattatatttgtgttgtagatatagatggttgtttgttatttattaatttagtaaaaaagttatagaataatgttaggataattttatttttatagtatagatgtatgaaaaaaagttgaaaatttgtatattagaatgttaataatgtttttagggggtaattaattatttataattaaaattgggttgttttttttatggatttgtttatagtttggattttattgatattagtattatggtgttatttaatttgtttttttttgtattttttataaatttgtaattagttttagagattttatgaggtttaggtttaatgatggttaggtggtggggaaagagtattttataggtgatgttgtgtgttttttttaggaggtatatgatatgtggttgttatttttttttttatgatgttggtagtttttttattttattattttattaggggttataaattataatgaaatgttaatggtaataataattttatttttatttatttgttagttgaattatttttataaagataaattttttagaaattattttgattattttaaagtatgggtagtattaattttttttttttatttgttagtgtttaaaatagtgagttggtttttttaatatttgttaaaggtgattaatgaggtttgtttggttgttttagtattattgtgtatgtttggattttatgattgtaaattatttattatttttttggtgtttaaattgttttatttttggtagagagttttttttagttgattgttgatttatttgataattagttgtttttgataatttttttgttttttgagttggtgagatgttttaggttattttgggtatttttggttttagatttggaattagttatttttttaagaaatgttgattttttttattttttttattattttttataaagattttgatttgtttttttgaatttttgaaaattttgaaaatttttgaaaattattattttttagtgtagtagatagaaaagatagtatatttaggagatttgttatatttatggtttagagggaaagatttaagggaggaagaagtggaagatatagtgttttaaaaggtatttaaatttatgaggatttattagggtttagatgttaatatgttttgtataggttattttattaaatttttttgataattttgtaaggtaggttttttttttattttataggtgtaggaattaaatttagatgattaaatgatttttttgaagttttatagtttggaagggggtgggatttagatttgaatttgggtgtgtttgttgttaaaatttatggtttttttttattgggaggaggaaggattgttgatgagttatggtgttttaggagtgttgatgattttttttagagtgtggttttgagtagtagaagttttattttttattaggtttgttagatttttgagatttaagttttattaaatagtaatatttaggtataggttttgtatttttttttgtttttttttttattatagtatagtgtagttgtaaggattttttttttaatggtggtttagataatgtggattttgtagaaattattggtagtaaatgtttagagtttttattggttgtttgatgttttttgaattttgggagttagttattgttttttttttgttgttgttggttagagattaggggagattaaataattaattatttgggtttttttttttaatgaaagtgaaataaaatattgagaattaggagataaatgttagtttggagaattttttaatgatttttattttatttttatttaagaatgatattaagttttaattagttattatttgttttggttttttaggtttttgttggtgatgtgttttttttttaagaagtgaagaagtagatatattaatttagttttatggatatttttttggtgtgtttgttttttagagaagggtgaggtaatttttttttataatttagataattggtaatgaggatatttttttaaaagttttttatttgaggtatagaggtaatttttttgtgtttgttaataaaaatgtgataaagtggtaagtatatgtaaattttttaaagtgagggagaaagattagaatgttgtagaatattttgtgtttttatttttgttttttgttggaaatttgtttatattatttaagattttgtagagttatgtttaggagttatagtgttagtataggaagtttattttttttaggggagaagagatggttataaggttagagtaggtttttttaaggtttggggtatatgtttaggtttgatagtttttgtagatatagtatttagttatttataatttggggtaggattgtggaaagaattgtattagaagagagaggatatattttttgttatatggtttttattttttgtatagaagttttattttttgatattttaaataggttattattaaagtttttgggaattgggttagtttgtgttaatttggtattgttgttattgtttgttaaagtttttgttgttaaggagagattagggagtatattttttagaaggtattttttatttgtgtttttaggataggttagttgatgagaagtttttggtgagttttggaaaggaaggttatttattttaaaaagtagtagtaggtagatgattgagtggttgtgagtttgaaaataatttttagataatttttttttttttttaagatagggttttgttttattatttaggttggagtgtagtggtgtaattttagtttattgtaatttttgatttttgggtttaagtaatttttttattttagtttttttagtagttgggattataggtatatattattatatttggttagttttttgtatttttagtagagatagggttttgttatgttgtttaggttgagtttttagataatgttttaagaaagttttgttttagtgttattggttgaagttgttaatgatgatgttttagtttatttgtgttgttgtaaaggaatatttgaggttgggtaatttataaagaaaagagattgatttggtttatgattttgtaggttggaatattgggtatttggtgaaagttttagtttgtttttatttatgggggaaggtaaaggggagttatgtagatattatatggtgagaaagtaagtgagagtgggggttttgggggggttaggtgagttaatatagtgaggatttattttttgtttgtttttatttagggtatttatttatatatgaggggtttatttttatgatttaatattttttattgggttttatttttaattttaggaaaaaattttagtataagatttgagggaataaatttttaaattatagtagatggtttttttgatattattttttttagtttttaattttttgtattaaaatttttaatatttgatatatatagattagtttttgtttttttgatggaatttttaatgaatatatgtgatgggggaatgtatgtttttattgataggttggttataggagatttttaaaaggaaagattatttaaaggtattatgttttttttttttttttttttttttgttggagggtattggttttatattggtttattgtaatttttattttttaagggatttttttattttagtttttagagtagttggaattatagatgggtattattatatttattaatttttgtattttttgtagagatggggttttattgtgttgtttaggttggttttgaatttttgggtttaagtaatttgtttattttagttttttatagtgttgggattataggtgtgagttattttatttggttggtaatatgttttaagataatgttggttaatggagtaaataataaagtttgaaaatttttaataagttttttgtttgggtgttggtgatagttgggattgattgtttagtggtagtggtgtagaggttttttttttggtttattgtggtttttatttaattttatttgtttttgttgtttgttgttgtagtaggagttggaggttgttgttgttagagggtaatgagttttagtggtgttttttttaagttaatggggttattgaggaggatatggttgaagatttgttataggggagaggttagaagaggttttgatgattattagtgagtgattagggggttatatagttttattttgtagtagatattatttttattgttgagtttaattattttggagattttgtggtaggagataaggatggtggagttgttttttagtagagttagagaataaaagttgtttttattttaggggagaatataatgtttatagtatttttaaaggttatgaattagggtttggttattagaaaagtttagaaattgagtaaaaaataaaattaggtggttataatagaatattgtttattttttattttttataaatgataaaattataaaattatggaaaagaagtggatgagataaaagagtagaaagttataatttgaatgatgaagatggatgattttaagatttatttagaattatagtattattaatgatttgaggattaatttatgatatttagaaattatatatagatattttgatgtggtagatattaaatttgttaatttggagtagttgatagaagttattgtggtagttaagttttatttatattagtgtaatgtgtttgtttatagtagtagtaaaggaattattgattaagtagtatgggttttttgattttgtgtaatagatattttaagttttttgaagagttttaagattttagtagtaggtttttttttttagaaataattttatttatatttaatgtaaaatgtagttatagtgggtagtatttgatgattagagattttttgttggtgaaggtgtgggattttaatatagagagtaggttgggattatattgggattatgagtatttgtatagtaagttttgttttttttatgagaatgattgtatttttgatagttttgaatgttgttggaatggtttggataggtgtatagttgaattataaataagtaagggaaattttttaatagttagaaatgaagagggagttgaaattagaattgtagtttttaaagatgtttattgtgagagaagttttatatttttggttggttttgggtgtattagttaatagtaggaattgttgttttttgtgaatagtaagttgtggtgtagagttgaagttttggattatgaggtgtggagttggaattgtgtttttaaagatgatgaggtttttgtttattggagtttagagggaagtttatttgagattttgtattggggtggttaaagtttttttgagatgtgtaagtatagttttttattataagggtttgaagtttttttttttttttttttttttgttttttttttttttttttttttttattggtttttttttgatgttattaaagttgtgaaagttgaggttggattgtattgttgttattttggtttattgtaatttttttgtttgatttttttgttttagtttgttgagtgtttgagattgtaggggtgtgttgttatgtttgattggtttttgtatttttttggtggagatggggttttgttgtgttggttgggttggtttttagtttttaattgtgagtgatttgttagttttggttttttgaggtgttgggattgtagatggagttttgtttatttagtgtttaatgttgtttaggttggagtgtagtggtgtgattttggtttgttataatttttattttttagttgtttgttttggttttttaaagtgttgagattgtagtttttgtttagtggttattttatttgggaagtgaggagtgtttttgtttggttgtttattgtttgggatgtgaggagtttttttgtttggttgtttagtttgggaagtgaggagtgtttttttttggttgttattttatttaggaagtgaggagtgtttttgtttggttgtttattgtttgagatgtggggagtgtttttgttttgttgttttgtttgggatgtgaggagtgtttttgtttggttgtgattttgtttgggaggtgaggagtatttttgtttagttgttttgtttgagaagtgaggagtttttttgtttggtagttgttttgtttgggaagtgaggagtgtttttatttggtagttgttttgtttgggaggtggggggtagtttttgtttggttagttgttttatttgggaggtggggggtgtttttgtttggttgttttttttgggaagtgaggagtttttttgtttagtggttattttgtttgggaggtgtatttaatagtttattgagaatgggttatgatgatgatggtggttttgttgaatggaaaagggggaaatgtggggaaaagatagagaaattagattgttgttgtgtttgtgtagaaagaagtagatataggagattttattttgttttgtattaagaaaaatttttttgttttgggatggtgttaatttataattttatttttaattttgtgttttttgaaatatgtgttgtttttatttagggttaaatggattaagggtggtgtaagatgtgttttgttaaatagatgtttgaaggtagtatgttttttaagagttattattattttttaattttaagtatttagggatataaatattgtggaaggttgtagggttttttgtttaggaaaattagagatttttgtttatttgtttatttgttgattttttttttattattgttttatgattttgttaaatttttttttttgagaaatatttaagaatgattaataaatattaaaaaaaaaaataaaataaaaaaataaataaataaataaaaataaaaataagggtttgaagtttgtgttggtggtagttgtgtgatttggaaaagtttatattgaggagtttttttgtttttatgagggtagtgtgtaggtgtttggaggtattgatgtttttttgggtttgatttttattttgtttatagattaatttgttagtttatagtgttttatagatgttgattgaagatatgaggtttttgggtttttggagtatagtaagtagtatgagttttttgttggtataggttttttagggggtgatataaggggtttaggtagatgttatgtaagtagtggggttgatgttatggttgatgtatgttgaggttggagaatttattgtttttttagtggatagttaataaatttgtattttgattagaagaaatatgattttatttttttagattatttgttgtaagtatagttttgagaagtggtttaggttaaaagaatggtgttttttgtaaatttagtgagaatatgtatggtgggtggttgtttttagtatatttaggtttttttggatttttttagattaaaattagttaaatatgagtttataggtaaaattattaagtatatatgggaaaagttattatgagtaagttagtagaattatagtggaattgaattttagagaatttagtttttgatattttaaattaaattaagaatgtttgagatatttatagattaaaggaaggaaatagtttgaattaggagttataagattattaaaatgatttggtagattggagaggaattaaagagaatgtttggaaatgataagtataatagatgaaattgtgggtttaataataggtttattttggttagagattttgaattagtagatggaaaggaaaattagaagaaatgtagattagagagttaaagagatagaaaatatgaaatataagaagtgtggaggttaggatgaggtatagtatatatttaaatagagaagtgtggggatatgaggtttaaagtgatagtggttaggaattttttgtaagttatgaaagtttgaatatatagaagtaggaagtatagaaatttatatttatattattatgaaattgtaggatattaagtgtaaagagaagattttaaatgtagttaaggaaaaagtataaattatagagagtagatgttgagattgagagtagattttatagtagttatagtgggagttggaagttatgtgatatagtgagtgtgatttgggattttttattattagtttagaattaggtattgaaatagatggttgtttaagaatttgtttatggtaaaggtatttttagatgggaaatagaatttattataataggaaatttaggagagtgagatttaaggaatttattgaagaatgtatttttagtagaaggagagtggttttggagaaagggtgtgattttgagataggtagatgaatagagtagttagtgaagatgtgagtaatggaaagtaatgtggattttaaagttttgttaattgggtgattttggttatttgggttgtggggagaaaaattagagtttttattaatattatatagtaaataagttttgaatgttttaaagtttagaagatgttatgggagagtatttttatggttttggagatgaaaggttttttttaataaggttttaaatgtttagtgaaggaaaatattaagaaatttaggttgattgtgttggtttaagtttgtaattttagtattttgggagattgagttgggtggattatttgagtttaggagtttgagattagtttgggtaaaatggtgaaatttgatttttataaaaaatatatatatatatatatatatatatatatatatatatatatatatatatatatataaatagttgagtgtggtggtatgtgttttttagttatttgggaggttgagatgggaggattatttgagttagggaggtggaggttgtaataagttgagattgtgttattatattttagtttgggtgatagaatgagattttgttttaaaaaaaaataatattgtagttaaatttagtggtttttggttttttggttttgtttttgttttttgagatagagttttgttgtgttgtttaggttggagtgtagtggtttaatttagatttattgtaattttttttttttgggtttaagtgatttttttgttttagttttttgagtagttgggattataggtatgtgttatgaggtttggttgatttttgtatttttaatagagatggggttttattatgttggttaggttggttttgaatttttgattttaagtgatttgtttattttggttttttaaagtgttgggattataggtgtgagttattatgtttggttaattatattaaattttaaatttttttattttgaaataaaaagtaaaaataggttgttttgtttatggagtagttatttttttatttttttattttgttaataaattagtttttattttaaaaaaaaagtgaaaataaaatttataaaagtaaatataatgaatagatttagtatttaaaatatgtaaagaattaggagttaataagaaggtggtaaatagtttatttaggaaagagtaaaaattatgattgggaatttgtagaaatggaaaaataaataaaaatgtttatttttagtgattagtaaattagagttagagggatgtttttttatatttattagaatgatgatgatgatgttagggaaaggaatgaaggttagtgggtgagattattgtttttttgtgggtttttttggtggtagtaagtttagttgggagttttttgtatgtatagataagaaaatgtatttagaagtttgaaatagtaaatatttggagatagtttaggggtgtattattaggggaatggataggtaggttgttgtttattatatgttaaaaagtagtaagaattaattatttgaattatatggattatagttgggtatagtggtttatgtttgtaattttagtattttgggaggttaaggtgggtagattatttgaggttaggagtttgagattagtttggttaatatggtgaaattttgtttttattaaaaatataaaatattagttgggtgtggtggtatgagtttgtagttttagttatttaggtagttgaggtaggagaagtgtttgaatttaggaagtagaagttgtagtgagttgagattatgttattgtattttagtttggatgatagagtgagattgtgttttaaaaaaaaaaagaattatatggattatataggtggattttataaagataaagataatttgtaaagaaagaaaatttaggtggaatatatatagtgtgatgatatttgatatgttatatttaaggtatgtagaagttttatttgtttttaagaatttgtaattatttaaaaatataaatgtgtatggggatgatatatatgtattttagtgagtgatttttttagttggggataggattggagatgatttttttagagtgggatatggtggaggttaattgttttagtaatgatttatgggtatttggatatttattgtattatttttttttttttttttttttgagatagagttttgttttgttgtttaggttggagtgtagtggtgtaattttggtttattgtaaattttattttttgggtttatgttatttttttgttttagttttttgagtagttgggattataggtgtttgttattatatttggttaatttttgtatttttagtagagatggggttttattgtggttttgattttttgattttgtgatttgtttgttttagttttttaaagtggtgggattatagtatgagttattgtgtttggtttattgtattattttttgttttttttgatatatttgaaatattgtgaagtatatttaaattatatatttttaagaatatttaaaagtttttttggtaatatttgtttattttatttatttttataaatatttttatatttttttgtttggaaatatttgttgagggatgggatgaaggggaatgagattttttagtgttttttttgtttagttttgattttttgtgtgatattattttttggtgttttaggttgttttgtaaaattagatatagttgtttgtttttgagtgtgtttgtattgtttttattttaggttagtattgatgtaggtggttaggtggttgttttgtttatagtgtggaaatgtttatttttaggttagtattgtttattaataattgataagtgataataaaattgtataaaagttgaaaaagttttatattttttttgttttttttttaatttttattaaagtaataaatatatatggtttttaaaaattaaatagtttagaagaatttttaatgaagaataaaaagtttttatttgtatattataaatttgtataaatgtatagaatgtatattattaagagtgatttgtaatgtaaatatggattttgggtgataataatgtgtttatgtaggttttttagtagtaataaatgtatttttttagtgggggatgttgataatggtggaggttgtgtatgtaggggttgtatggggaatttttgtattttttttttaattttgttgtaaatttataattggtttaaaaataaagtttatttttaaaaaagttttttttattttattttttttaattttagtttatttgttaaaggtagttattgttagttttaattttttggaatatttataaataatgttatttatatgttatataaataataatgtgtttgttattatttttgggtttattatttatagatgttaattattatttttttttttttgagatttttttttttttgtatttgtaggttagtggggaattggttgagttggttgggtttggttggttggattggttttaagttgtgggtttagttaggtatgttttttttgtaggttaggtttaggtttgttttggattttttttggggtttaagatgaagggatagggaagtttttgttataataatggtaaagttataagagggaaggtttagttgtataagtgtattttaaatttttgttaatattttattggttaaagtatgttatatggttatagttaggagtgaagaagtgtattgtttttagtagtaggtattgtaaagttatatagttaagggtttggatatagatagaagtgaagaattgggattttttatttaatttattatattttttataattttgtttttttatagatttttttgtaatagtattttagtttaaataatataatatagttttgtttaatggttggttttttttaagtggttgatagatatttgatgagttttttaaattttaatatttttataggtttttgagaaggaattttgttagatagtttaggtttggtggatgaagaaagtttgggtgtgggttttttaaagttagtttggttggaaatattttgtttttttttttttttttatgaagtgaagagtgtttttagatggtgtatagatagtgagttgttatggaaatattatttgatttttttagaagattattatattgatatagtgttgttttattttgtatttaaaggtaatgtttttgtgtttttaaggtttttgatattatttgggggaagtttagtagggttatgttggttatttttgttgttatttttttgtttagaggttttttttattttttttttaattttgatggtgattgttgggaaagttaaatttgagtatttgagtatgttaattttttgttagtgtttttttgtttgtatgattgaagtttaggtttttttatgtggattatgatgtttatatttgttgtttaatattaagaattatgtaagtgtttggagttgtagttgaattaagagaaggaaaaattgaagatatagaaaagtaagggagtgtgtatttgatgagttggagtagggatttatgggtttttttatgtaggaaaagagtagttttttatttttttagaatggagggaagtttgggtagagaggtagagagggtgtgtatatgtatgtgatattgggttagttttttgtgatatgggaggtaagatattttgagaatgagtggggtgggaggttgtgatgtgggtttaagtagtgagttagatttatggaagagtttatatgtggatagggagaagtttttgtgtggattttgtggttagttattgggattgtttagtatgttgggtttagaagataagtttttttatagttttagttgagggattgtttgattttttggggtttgggagttgagaaggtgtttggggtgggaggattgggatttagaaaattgagggtgtttttggggagagttttattgatggtttgagttatgtagggaagtaaggtaagaaagaggtagtagaattaagtgttatggagtattaagttatttagtatttttttttttttgaggtagagttttatttttgttgtttaggttagagtgtaatggtatgattttggtttattataatttttattttttaggtttaagtaattttttttttttagttttttaagtagttgggattataggtgtgtgttattatatttggttaattttgtatttttagtagagagggggtttttttatgttggttttaaatttttgattttaggtgatttatttattttagttttttaaagtgttgggattataggtatgagttattgtatttggttattatttagtattttaaagttagttggaaatttagtattttatgtaggttaataagaatggggttaatatgtattgagagttaattaggtattgtgttaagagatttgtgatggtatttatttgattgtatttttgttagtaatgaatgtttttatttaatttttggagggatggtttttttgtttgtttgtttgtttgtttgtttttttttgagatagagttttgttttgttatttaggttagagtatagtggtgtgatttattgtaatttttgttttttgggtttaagtgttttttttgttttagttttagttttttgagtagttgggattaaaggtgtttgttattatgtttggataatttttttgtatttttagtagagatagggttttattatgttggttaggttggtttttaatttttgattttaagtgatttgttggttttagttttttaaattgttaggattataggtatgagttattgtgtttggttagggggtgggggatgattttaatagtgtaaaaagtttatataaatttttattttttttgtgagttttttagaaagtatgtttatgtatggggtatgtgtataggtatgtgtgtgtgatagtggtttatttatgttttttgattatgttggaaaatattttaatattttagttttaaattttgttgttgtttgtttgtttgtttttgagattgggttttgttttgttgtttaggttggagtgtagaagtataattataatttattataattttgattttttgtgttgaagtaattttttttatttagttttttgagtatttgggattataggtatgtattattatatttagtaaatttttaaatttattttttgtagagatagggttttatttttattatgttgttaaggttggtgttaatttttgggtttaagtgatgtttttattttggttttttaaagtgttgggatgataggtgtgagttattatatatggttattttgaatatatagaataagttttaggagtaatttatatgttgaagagtaattatagttggtgtggtaaatatgaaagtttaggagaaagattaagttaattgtggttttggtggttttatttggttattttaggaatgtttatttttttattttgttgtagtgatttagtttgtttttttgatgttgtaggtatttttttatttggatgtttaaaattgatatttagttgtgagaagtgttttgtttagaagaaagagttgaataagaagtttgaagatttatgtaggaagaagtttgttgagtttgaagatgagttagattatattgtggatagtttgatatggaatttaatttttaaggttaaagaaaggattagagaattttttaaggttagtttggaaggttgtgtagagtagtgtttggggggatagagaggtagtgaaggggaaggtatttagatgatatgagaagttgtgatgaatttattgtaaaatagagtagagtttgtgttggttatttatgggttatgtagttggttaagatgttaataagtataatttttttgtttgttattgattttatgtttttgtatgttttaaagaaagtaagttaattaaggaataaaaattggatgaattatttatgtgtgttatagagagagttagatagatttttgtttgttagaatggagagttggaattattttttaaaaaatttttgtttttttttttttaatatttgatatggaggtaagttttttgttttttttttaaagaagttagtattgataggagaattttagagtatagagttagaatagaggtatgtttttttttggtttgaatttttagaaaatttggtttatgagagttaatttagatggttttttgtttggtttggttgtagaggtttttagatttgtggggtagggtagtagtattagaatagagtagggttgtagggttatttattggtgtggtttttgaattttttttagagttttgggtttatgtttttttgatttgttaggggttttgagaaataggggttggtgttggttttttatttatattggagtaatttgggttaaatggaagtaattttgttagagatataggttttgagtaataatagtatttgaaatttgattgattataaataattagtgtaaattgtgatttttttttaagagtgtttttgtttatatattagtaattgtttttatgaaagtaatgagttgttttatgggtttataattttagtaagtttaaaattattaatatttttttattagataattaatattttttattaagaaaaattagatataaaaattagttgggtatggtggtatgtatttgtgattttagttatttgggaggtggaagtggaaggattatttgagtataggggtgttgaggttgtagtgagttaagattgtgttattgtattttagtttaggtgatagagtgagattttgttaaaaagaaaatagaagagaagagaagagaggaggagaaaagagaaagaaaagaaagaaagattagaaaagattaatatttgagatatttatattaaaaatttatttatttattggtgtttaaatatgtagagttttttttatgtatattgaaaatgaaatatgtagttatttatgtttttataaagattggattatattgtaaaattattttataatttgtattaataataagatttaaaaattttttaataaatggtatattgtgaatatttttgatggtttttatgtatttatttttatattaattagttattgtttattattttattgtatggatgaaattaatagtttttttttttttttttttttattttatagttgtgttgatattttagtgtttttagttaagttattaattgggttttttatagattatgaaattggtttagtttatgaggtagatattttgtttttttatagtttttattttatttgtttttttatttttaaaaagtttttattatggaaatttttttttttttttttttttttttttttttttagtatttattgattatttttgggtgttttttggagagggggatttggtagggtttaggataatagtgaagggaaggttagtagataaatatgtgaataaaggtttttggtttttttaggtagagggttttgttgttttttgtagtgtttgtgtttttgggtatttgagattagggagtggtgatgatttttaatgagtatgttgtttttaagtatttgtttaataaagtatattttgtattgtttttaatttatttaattttgagtggatagagtatatgttttagagagtatggggttgggggtaaggttatagattaatattattttaaggtagaagaattttttttagtatagaataaaatggagttttttatgtttatttttttttatatagatatagtaaaaatttgattttttttttttttttttatattttttttttttttatttgataaaattgttattggtattatggtttgttttttatgagttattgggtatattttttagatggggtggtggttgggtagaggggttttttattttttggatggggtggttgggtagaggtttttttattattttttgggaagggtggttagttgggtgggggttgttttttattttttggatggggtggttgtggggtagagatattttttagtttttagatggggttgtggttgggtagaggtgttttttatattttagatggggtggtggggtagaggtgttttttatattttagatgatgggtggttgggtagagatgttttttattttttagatgggatgatggttaggaagaggtgttttttattttttagattgggtggttgggtagaggggttttttatattttagatgatgggtggttaggtagagatgttttttattttttagatggggtggtggttgggtagaggttgtaaatttagtattttgggaggttaaggtaggtggttgggaggtggaggttgtagtgagttgagattatgttattgtattttagtttgggtaatattgagtattgagtgagtgagattttgtttgtaattttggtattttgggaggttgaggttggtagattatttgtggttaggagttggagattagtttggttagtatagtgaaattttgtttttattaaaaaatatgaaaattagttatgtgtggtggtgtatgtttgtaattgtaggtatttggtaggttgaggtaggagaattaggtagggaggttgtagtgagttgagatggtggtagtatagtttagtttttgtttggtattagagggagattgtgtagagggagagggagagggaggagagggagattgtgtagagggagagggagagggagagggaggagaggaagattgtgtagagggaaagggagagggagagggtggaaatttttaattgtatataaaattagggaaaagattataattattttttatgtgtttaatatgtagttttaatagttatttatattttgttaatttggttttgtttattatttttataatttttttatgtatatatttatatgtatatgtatgtgttggagttatagaaggaaaatatgatattatgttattttttagttaatatattaattagtatttttaatagataagggttttaaaaagtaattatagtattattgttatatttagttatattaataatgattttttaatattaattaatatttatttatgtttgatttttatttgttttaaaaaaaagtttatttatatttggtttttttgtattagaatttaaatattgtatttgattaaagtattttttaatttttttttagttgataataattttttttttattttttgttttttaaaaatgttatttatttgttgaagaaattgtaattttgtatattttggatttggttaattgtgttattgtggtgatattaaatgtgtttttttattttttatattttttataaattggttattagatatagagatttgatgagatttaagttttatttttttttttttttgataagaatatttttttggtggtattgtgtattttttattgtaatttattaggaggaagtatgggatttgggttttttatgattagttatgaatggtattaggtgttgaaattttgatttattttttataaagtttttattaaatttttatttaatagttaatagtttagatgattgttagatgattattgtttagatttattttttttttaattagggtttataaaatggtaatttttaattttattattttatttatatttattagtttgattttttatttaaaaaatagaataaaattttttttttaattttgatttttgttttttttttttttttgtatttttttgatatttataggtaattatttttattagtttgtatttttttattgtttttttttgaattataagtaaatatgtatatatagttgaatttttttttttttttattgttttttatattttaatagtatatttagtaatttttgtaagagtagaggttttttttattttttttttttagttttttttttttagaagttttttatttttttggggaattaggttaagattaagtttagtagttattaattttgtttattaggtataaagataattaggtttaatgatagtaatttttttatatgtatatggattgtattttatagtttaaagagtatttgtttatttataatttttgaggaatgttttaattatttatggtaaaaagtagattaatatggtagttttatatgttgaatattagaggaagtattttgtttattttttggatttaatagtaatgtgttgttttttgtatttttgtgtttgggatttttgtgtttggttattatgttttaaggatagttgtagaagttggtaaatatttagaggaaaggagttaaaattatgttagttagggaatagaatagggaaaagggagagttgttgatggatttatggaagatatttttttttagggtttttagatgtttgttgtggaagtttgtgtttagagtttggagattttgaggttgtagatgaggtagatatagattgttatggaatagttttttttttgatttttgtttatttgtttaatttttatttttttgatgtttataatagttgtttatttggttaaattataaagtgtaaggataaaaatagtttaaatttttagtttttaaaaatttatgttttatgtattttttttttgaaattttttagggaatatgtttttttaatagaaatgaggaaattaatgaagaggaaggtatggaatgtggtattaagagatttaatataggggagaggtgaaggaaatttttaggttaataatttttaagagattttgtagttaatattgttgtaaagtaaaattttttaaagtttagtaatttaaaataattattttattatgtttataaattttttgggtgaaaaatttagagagagtataatgggaatgatttgttttataatgtttgaggttattgttggaaagagttagtgtttaggggtgatataaaagttggggttgatgttgttgatgttgttgtagatagagagttgaggttgtttattagaatgtttatattatatagtttttttatgtgggttgtgtttttttatagtatggtaattttaggttaattagatttttatatgataatgtaagtgagtatttgtatttttttttttttttttttgagatggaattttgttttattatttaagttggagtgtagttgtaggattttggtttattgtaatttttgttttttgggtttaagtaatttttttattttagttttttgtgtaattgggattataggtatgtattattatgtttggttaattttttatatttttggtagagagagggttttgttatgttggttatgttggttttgaatttttgattttagatgatttatttgttttggttttttaaagttttgggattataggtgtgagttattgtatttggttaagtatttgtatttttaagtgagtattttagtaagtaagaaggagattgtattatattttatgatttaattttgtaagttgtatagtattatattttttgtatgttgtagattataaataagttattaaggtttatttagatttaagggaagatatgtagattttatttttttttttttaaaatttttttttttgaaataaggtttggttttgttgtttaggttggagtgtagtggtatgattttggtttattgtaatttttgttttttgggtttaagtaattttttttaatttagttttttaagaagttggggttataggtgtaggttattatatttggttaatttttgtattttttgtatagatgggtttttgttatgttgtttaggttggttttaaatttttgagtttaagtaatttatttgttttggttttttaaagtgttaggattataggtgtgagttagtgtttagtttagattttatttttaatgagaatagtgttaaagaatttatggatgtgttttaaaattgttttaggagttattttatatgatagtagtaggtgtagtgggtaattagtttagattagaagaggttagaaagttttaggagaggttgatttatggagatgatattgagaagagtttttgatatatttggatatatgggggagagatttgtagggtggtggagaaggattgaattattgataagtataaagtaaataaaataattagttgattatttattttaggaaaattaaaaattgtataaggtagggaaaggaattattttatgtttagttgtgaatagtaattatttagtaatttgaatataatatgaattattaatttaattagtagtatgatataattatattggaaatatgggggataggaagggtgtgttatatggtgagttagatatgggagagggaagagggaatatttatattttttatttataattaatatttaaaattgaataaaagtagtatattatttggagatatggaaataaatattaaaataattagttaaaggatgaaaaagtgtttatttttggggagtgggaaatggtaggatggggttaggggaagagggtagtattttatttttaaaattttgttgaattttgattttttaaattatgtggttgtttaatttagaagaaaataatttaaaaaaatttaaaattttttataaaaagaaatattaggtttagattattttgtaggtatagattatgaaatatttgagttattttttattttatgaaattattttagagattagaaaaagagggaatgtattattattattaggtaataagtttaattattttgatattaaataaaaatatatattagttttaagaatataggtgtagaaatattaggtaaaaaatagtaaattaaattaaatagtaaggaataatatatatatatatatatgtagttaattttttgaaatttaggaatgtagggaatgtttttatagtaggttttgagttggtagttggttttgttgagtttattattttttttttttaaagtttttagtgttgttaaggaaagttagtttatgttatagtttttataatgattattattttaaattttgtagttattatagttattatgttttattttttggttttttatttgtattttattttagttgattattagtgaaagttttggtaattgtgataatattattttatggtgtttatattttagtttttattagttgttttatagatggattggtgtaatatgtagtgttggttaaaaattgatgtaaatgttgatttaggaatataaatttataaataaaaataggaagatatattttatatttatgttaatttttatttggtggggggttggtagaggattttaattttatttgtaatgttttattttttaagttgggtgatggaaatatggtttttgttatgttataatttatatattgttttttagtgtaatattttataaaatattaataaaagatgtgtatttgtattgatgtgttatatattgtgttgggtgtagttggaggattaggtttagattttgtttttgggggttttttaatttggggtggtagaaaagaaagtggggtttaaagggggtgagtgggttgtgtaagaggtttaattatattttgatatagaggtgttataatattttttgtgtttatgggaagaatggtttagagatatgtgttgaggaagatagtaagtaagaggtgaggtgagtaaaattttgaaattagatattttaggtttaaatttaattggtgtttttttgaattttagtttttttagttgtgagatagaaatagtttttattttttttggttgttgtgaggttgaggaggtatagagtagatgtttataaatagtaattgttattttaaataataggttagttttatgtatgtttgtgtgaagagattgttaaataagttttgtgtgagtaataaaagtttttaattatttgggtgtaggtgagttgtgtttataaagagagttagtgaaaagagatggggtgggtttattttataagatttgggtgggtaaaggaaaattgtagttaaagggggtttgttttttggtgggtaggagtgggagttgtaaggtgtttagtgggggagttttttgagttaggaaaaggatttttataaggtaatgttattatttaaggtaaggattggttatttttattttttttgtggtggaatgttattagttaaggtggggtagggtatttttattttttttgtgattttttagttattttaggttatttgggtatataggtgtaagttataggagatgtgatggtttgttttgggtttagaggtttgatatttttgtttttttatattaataagaaaaatgaaataaaatagtgttgaagtgttggggtggtgaaaatttttgggggatggtatggagagagagaatgggtgatgttttttagggttgttttaagtgggattggggtagtgtgggaatttagagtgggagagagaaagttgaagggagattttgtggtaagtggtgatattgtggggttgttagaagaaatatttgttgtatagaatgattggtgatggtttggatatggttttggatgaattgagaaattaaatggaagatataaggtttgaataaaagaaggagaaaaatgggtattaaaggattaagaattgggaggatttaggatatttaattagagagtgtttaagggggtttagtgtaattatttgtttggtttagaagtgatttttttgaggatagatttttatgatggaaaggaaatgagaggttttaagagatgggttagtggtttgtaatttatatggaagaggttatgaaatgatgatagaatagaatgggtttgtgaggttggaaggaggtattttttttggtttaagaattatttgttttgtgtgggaagagattgataggtggaaattttagtggggaagtaggtgggagtgattgatgtgaaggagaaaaattggttttgagggatagaagttggagagttagttgtttgtttagttattttattagtataagtgttgtttagagtaatgggatttgatgttttttgatgttttttgtagtgaatgattttagttttttttggaagtaaaggggttttgagtagagtttttattaaagaggtattaatgatggaggatttttgtgtagtgagggagttttttttagtttatatgattatatggtggtgtagaatatgaaaggtatatttagaattagtgtagatattgatgtatagtttttttttaagagtgagggtttgagttaaggtaattagtttggtttgttgagaggtagtggaggggggtagagtggtagttttaatgatagatgtggaagatattatagtatagtttgtttttgttggtgagtggtaattaggtttggtggaattgttattaataaattaagtgtgattagggtgagaaataaggaagaaggaaatgtggggaaatggggtgaatattaggtggattagagagatgtagttatgagggttaggtgtggtatttggaataatgtgggaggttagattgaagtttaggttaggaataatggtaattgtgggagatttaatgaagagtgagtgtagttgaaggagttggggagtagaaagtatatgtgttaggtgtgaggaagaaaatagattttggaaattatgagagttgtagagagtgagttgagtatagtttgtgattttgagggtttttaaaagtattagggtggtagtagttattgtatggagatatgatggttagtttaaaatagtaaggttaagttgtttggataaaaaggttataggatgtgattttggtttttgtgtaagaattttgattgtatagttttgtattttggttgtgtgtaatgaaaagagttgggatgagttagggagagttagagtgggggtagtttttaaagttgtttttaaggaatagaaagaggagtggggaaaggatttaggatttatggggttaattaggtttttttttgtgagtttatataatggttttgttaggatggtaaaattaggtatttaaaggtgaaaatatttaattatgtttaggaaggaaaggagttgttgttttgtagaaggggttggggtttgagagattagttgggtatgattggtagggagagtatgtgtgtttttatgaagaattatgttgaggtaggtaatggatggagaagatatttgagttttggagggagatatttgatattttttggagaataaatgttgaaggagtagaagtgtgttttgttgagaagatttaaaggaggggttataaagaagaaggttattaatatattgaataaggtgagaagtggaggggtggaaagaaagtaaattatgagaaagagtttggttgaagtaatgagggttgtttttgaaattttgtggtagtatagtttaggtaagttgttgggattgatgggtgatagggttagtttaggtgaaagtaaagagaggttgggatgaggagtgtaggggaatagtgaaaaaagtatttttaagattgagaatagaatattgagttgtggaggaaggtattgaggataaaagagtgtatgggttgggtattataggatggatggtaaaataatttggttgataaggtgtagattttgaattaatttgtaagatttgtttggtttttggataggtaaagtgggggaattgtaaggagagtttttaggttttagaagtttatgttgtagtaggtgagtgataataggttttaatttttttaaagtgtgttgtgggatgggatattggtattgagtggggtaagggtgattaggttttaatgggatggtaataggtatgtgattagttgttagggaaggagtagagatgttttatatttgtgggttaaggtggggggatatgagaggaagatataaaggaggttttgggttggggagaagagtggtaatgagatgtggttatagtagttagggaagtagataatttggttaaaatattttggtttaataagggaattgggtaggtggggataattgaaaaagagtgtataaaagagtgttgtttaagttggtattagagtgggggagtttttaggggttttgaagtttggttgttagtatttataatagttattggggttagggaaataggtttttgaaaagaaggtaatatggagtgggtagtttttgtgttgattaaataggggatggatttattttttattgtgagagttatttgaagtttagtatttgtgatggtttagggggattttgaggtgattgggtagtattaatttttagttgttaagttgagtagatttgggaaggagttggttagagagttttgggttagagttttaggggttttaggagtggttgttgggtgagttgggtagtttgttttttagtgggtttttatatagatgggatatggtttggaaggaattttgggttgtaggtattttttggtttagtggttagatttttggtatttgaagtaggattttgatggaggaagttttgtaggaatgtttgattgttgtagtttaggtattttgaagtttttgtatgttggaggtgtggttgagttttgttttatagtagaggtaagtaattgtaatttagaaatgtgttgttatttggttgttttttttttattattgtatattttgaaggtgaggttgattaatttttgtttgtggggtttgagggttagattttaatttttgaagtttttttttaatgttaggagtggattgggtgataaaatgtatattgagaataaggtggttttttggtttttttgggtttagggtggtaaagtgtttaagggttgttgtttaagtgggttatgaattgggttgggtttttgtttttattttgggtagtttttttaagtttgttagaattaatagttttgtaagttgtttttttaagttttttaattaggtaggaaattatgtaattttgtttagttatatttggggaatttgtttggtagttttattggggatttttttggggaattgttttaatgtttttttggaggttaggtttatgaagttggtggttattagtatgagattgggttagagaaaaaatttttttttgtttatttggggagagggtagaagttaggatgatatttaagttattttaggttaaattgtaggatagagttagatattagaatttttgtatatatttagtggggtttgatgagaaagagtttaaatgttgattgatttgagagaggtttgatagagaaaaaggtatatgtattttgattatgtttttagttttagttatttttttaagaggaaattgttgggtgggtggggaaaagttagttgtagaattaaattgtaagttggattgggtgtgaggaggggaggtggtagaaggattataggatggaagagtggaggttgaggaagaattgggatttagtttaatttggttatgagtagtttgaggaggaggggaaaggttagatgggtttgtagaaggaagattggaaagatttaatgatgtttggggttgggattgagggggtaggtgggaaggaaagaaggaggatttgggaggaattgtattgggaatagagattagggagggaataaagtgtgaaaagtgtttggatgtaaggtattttagattatttgtttattttttgataaaaattatttaggttttgtaggatggagaaattgaaagtgttattttttggttatttagagttattgttaagtttgtattggggttaagtagtgttgtagaagaaaataaggtatttaggttttaggttagatgtgagttgaagaggttttaagtttttgagaatataggttaagggagaagaaggaggaatggagggtggaaggttgtttatagtgaaggaggtaagtttagagaaaagagagagtagagatatggagggaaggggtttgggggtttttattttttagaaaagtgggaaaggggttggggtgtggaaataaggggttggggtatagagataagaggttagggtatggaaataagggattggggtgtagagataagaggttggggtatagaaataagggattggggtatagggataagaggttggggtatggaaataagggattgggggtttttgttttttagaaaagtgggatttgttattaagggtgaaggagaaggggttgaggggtttttgttttttttttagaaaagtagagaaggggtagagatttagagagaaggggttggggtatttgttttttttttagaaaagtgggatttgttattaagggtgaaagattaaggtaggtgtttttgtgtggtttgatatttttgaaatgtgggtgaataattagagaggtatttttgtaatgattaaatattaagggaaggttgtttttttagtttgtgattggtattggagttttgggtttatggataaaatatgttttttttgtttttattagaaaatgaaaggaattgaaattaagagaagggagagattgaagggtggtgttaagattgaaaggagaaagaggttgagggatagtgagggaggttggagaagagagtaaaaagaggttgtttattagatttgaaattggtgagatgttttttgggtttattggtttgaggatttgaggttgtaggtggttttatgtgtgtttgtgtgaagagattattaaataggttttgtgtgagtaataaagttgtttattttatttgggtataagtgggttgagtttgaaaagagagttagtgaagggagatggggtggggttgttttataagatttgggtgggtaaaggaaaattatagttaaagggggtttgttttttggtaggtaggagtgggggttgtaaagtatttagtgggggagttttttgagttaggatgagttaggaaaaggatttttataaggtaatgttattatttaaggtaaggattggttatttatattttttttgtggtggaatgttattagttaaggtggggtagggtatatttattttttttgtgattttttagttattttaggttatttgggtatatatatgtaagttataggggatgtaatgttttggtttgggtttagaggtttgatatttttgtttttttatattaataagaaaaataaaataaaatagtggtaaagtgttgggatagtaaaaattttgggggatggtatggagtgataatgggtgatgttttttagggttgttttgattaggattaggggtagtgtgggaatttagagtgggagagattaagttgaaggaagattttgtggtaaggggtgatattgtggggttgttagaagaaatatttgttgtgtagaattattggtgatggtttggatatagttttgtatgaattgaaaaattaaatggaataagagaaggagaaaaatagatataaaaggtttaagaattgggaggatttaggatatttgattagagagtgtttaaggagatttagtatagttttgttagtaaagattatttatttattttaagagttaagaatggtagtttggggatagtatgaggagatattagttgtgatggtttggagaaatagtgtaaattggtagtgtaaataagagtagggtatgtatgagtagttgagaatggagaataggagtatgattagatagaaaatagtagggatgataagtgtttttggggtatagtttaagttggtttagtgtttggaatgagattgggatttaataaaaaggagtttaaatgggttgtattttgtagtattttgaggataggtttgatttttgagaagggaaagtggtgaaagtattgtttagttttttttaagttggtggttgagtttggtgaggtttgtttttaaaagatttttagtttgttttattttttttgaagatagaggattgtaagggatataaaggttttttgaaaaattgtttggttgatttgataaataaaggttggtttgttattagattgtatagaggtgggaaggttaaattgaggaattatgtttgatagaagggaagaaattattgggatggtttttttagattttgtaggaaaggtttttatttatttagtgaaagtgtttatttagattaagaggtattttagttatttgatttagggtatgttgagtaaagttaatttgttagttttgggtgggggtaaatttttaagtttgatgtgtagggaagggagggggtttgaataatttttgaggagtagtagaatagtagatggaatattgagaagttatttttttgaggatagatttttataatggaaaggaaatgagaggttttaagaggtgggttagtggtttgtattatagtatagtttgtttttgttggtgtgtggtgattaggtttggtggaattgttattaataaattaagtatgattagggtgagggataggaaagaaggaaatatggggaaatggggtgaatgttaggtggattagagagatatagttatgggggttaggtgtgttattaggaataatgtgagaggttagattgaggtttgggttaggaataatggtaattgtgggatttaataaagagtgagtatagttgaaggagttggggagtagaaagtatatgtgttaggtatgaggaagaaaatagattttggaagttatgagaaatgtagagagtgagttgagtataatttgtgatttttagggtttttaaaagtattaaagtagtagtagttgttgtatgtagatatgagggttaggttaaaatagtaaggttaagttgtttggatagaaaggttatagggtgtggttttggtttttgtgtaagaaatttgattgtattaattatgtttaggaaggaaaggagttgttgttttgtaatagattgaggtttgggagattaattgggtataattagtagggagagtatgtgtgtttttatgagaattatgttgagataggtaatagatgaggatgaaatttgggtttgattgaagtaatggggtttatttgtgaagttttgtggtagtatagtttaggtaatttgttgagtttaatgggtgttagggttagtttaagtgaaagtaaagagaggttgggatgaagggtgtaaaggaatagtaaagaaagtatgtttgagatttagaatagaataatgggtagtagagggaggtattgaggataggagagtatatgggtttgatattatggggtggataggtaaaataatttggttgataaggtatagattttgaattaatttgtaaggtttgtttggttttaggataggtaaaatggaggaattgtaaggagagtttataggttttaaaaggttatgttgtagtaggtgagtgataataggttttaatttttttaaaatatgttgtgggatgggatattggtattgagtggggtaagggtgattaggttttaatgagatggtaaggggtgtatgattggttgttaaggagggagtagaggtattttatatttgtgggttaaggtgggggaatataagaggagggtttaaaggaggttttggattgggaagaagggtagtaatgagatgtagttgtaatttaggaatagttagggaagtagataatttagttaaagtgttttggtttaataagggaattgggtaggtggggataattaaaaggagtgtttaaaagagtattgtttaagttagtattagagttggggagttttaagaggtttagaagtttggttgttaatatttataatagttatggaggtaagggaaataggtttttgaaaataaggtaatgtggagtgggtagtttttgtattgattaagaaggggatagatttattttttattgtgagagttatttaaagtttggtgtttgtgatggtttagggggttttggaggtgattgggtagtattagtttttaggtattaagttaagaagatttgggaaggagttagttagagagttttgggttagagttttaggggttttgggagtggttgttaggtgagttggatagtttgatttttagtggggttttatatagatgggatgtggtttaggagaaattttgggttgtaggtattttttggtttggtggttagatttttggtatttgtagtaagtttttgggggaggaggttttggaggaatgtttggttgttgtggtttaggtgtttggaagtttttgtgtgttggagatgtggttggggtttgttttatagtggaggtaaggaattgtaatttttttttattattgtatattttgaaggtgaggttaattaagttttgttgtggggtttgagggttggaatttaatttttggagttgtatttaatgttaggagtggattgggtaataaaatgtatattgagaataagatagttttttgattttttagggtttagggttgtaaagtgttttagggttgttgttgaaggagttatgaattgggttgggtttttatatttgatgaaaaagtttaaatgttgtttgatttgggataaagaaaaaggagtattaattttgattatgtttttagttttagttatttttttaagagtaaattgttgggtaggtgggggagggttagttatggaatgaaattgtaagttggattaggtgtgaggaggggaggtgataaaaggattatagggtggaggagtagaggttgaagaagaattgggatttagtttggtttggtgaggaggggagaggttagatgggtttgtagaaaaggaagattagaaagatttaatgatgtttggggttgggattgaggggataggtgggagggaaagaaggaagatttgggatgagttgtattgggtatagagattaggaagggattgatgtgtaaaagaatgtttggatattaggtattttagattgtttgtttattttatgataattatttagattttgtaggatggaaaaattgaaagtgttgttttttagttatttggaattattgttgagtttgtattggggttaagtggtgttgtagaagaaaataaggtatttaggttttaggttaggtgtgagttgaagagtttttaagtttttgagaatataggttaagggaggagaaggaggaatggagggtggaaggttgtttatagtgaaggaggtaaatatagagagaagagagtgtagagatatggagggaaggggtttgggtgtttttttttttttttttttttttaatttattttttattgataatttttgggtgttttttatagagggggatttggtagggttatgggataatagtggagggaaggttagtagataaataagtgaataaaggtttttggtttttttaggtagaggattttgtggttttttgtagtgtttgtgtttttgattatttgagattagggattggtgatgatttttaatgagtatgttgtttttaagtgtttgtttaataaagtatattttgtattgtttttaatttatttaattttgagtggatatagtatatgttttagagagtatagggttgggggtaaggttatagattaataggattttaaggtagaggaattttttttagtgtagaataaaatgaaaagttttttatgtttatttttttttatatagatatggtaattatttgattttttaattttttttttattttttttgtttttttattttataaagtagttattgttattttggtttgtttttaatgagttgttgggtatattttttagatggggtggtggttgggtagaggggttttttattttttagtaggggtggttgggtagaggtgttttttattttttggatggggtggttggttgggtggggggttgattttttaattttttttttggatggggtggttggttgggtagaggggttttttattttttagtaggggtggttgggtagaggtgttttttattttttggatggggtggttggttgggtagggggttgagttttttattttttggatggggtggttggttgggtggagggttgatttttttattttttttttggatggggtggttggttgggtgggggggttgatttttttattttttttttggatggggtggttggttgggttgaggggttttttattttttagtaggggtggttgggtagaggtgttttttattttttggatggggtggttggttgggtggggggttgatttttttattttttttttggatggtatggttggttaggtggggggttgatttttttattttttttttggatggggtggttggttgggtggggggttgatttttttttattttttttttggatggggtggttgttgggtggagatgttttttattttttagatggggtggttgttgggtggagaggttttttattttttagatggggtagttgttgggtggaggggttttttattttttagatggggtggttgttaggtagagggtttttttattttttagatggggtggttgggtagagattttttttattttttagatggggttttggttaggtagaggtgttttttatattttagatggggtggtggggtagaggtgttttttatattttagatgatgggtggttgggtagagatgttttttattttttagatgtgatggtggttgggaagaggttttttttattttttagatgggatggtggttgggtggagatgttttttattttttagattgggtagttaggtagaggggttttttatattttagatgatgggtggttaggtagagatattttttattttttagatggggtggtggttgggtagaggttgtaattttggtattttgggaggttaaggtaggtggttgttttttgtttttgggttttgtggggtttgttttggtttgggtgtttttaattttttagaaaagtgggaaaggggttagggtatggaaataagggattggggtatagagataagaggttggggtgtggaaataagggattgggggtttttgttttttagaaaagtgggatttgttgttaagggtgaaggagaaggggttgaggggtatttgttttttttttagaaaagtagagaaggggtagagatttagaaggggttggggtatttgttttttttttagaaaagtagagaaggggtagagatatggagagaaggggttggggtatttgttttttttttagaaaagtgggatttgttgttaagggtgaaggattaaggtaggtttttttgtgtggtttgatatttttgaaatgtgggtgaatgattagagaggtgtttttgtaatgattaaatattatgggaaggttgtttttttagtttgtgattggtgttggagttttgggtttataaataaaatgtgttttttttgtttttattagaaaatgaaaggaattgaaattaagagaagggagagattgaagggtggtattaagattgaaaggagaaagaggttgagggatagtgagggaggttggagaagagagtaaaaagaggttgtttattggatttgaaattggtgagatgttttttgggtttattggtttgaggatttgaggttgtaggtggttttatgtgtgtttgtgtgaagagattattaaataggttttgtgtgagtaataaagttgtttattttatttgggtataagtgggttgagtttgaaaagagagttagtgaagggagatggggtggggttgttttataagatttgggtgggtaaaggaaaattatagttaaagggggtttgttttttggtaggtaggagtgggggttgtaaagtatttagtgggggagttttttgagttaggattggttaggaaaaggatttttataaggttatattattatttaaggtaaggatgggttatttttattttttttgtggtggaatgttattagttaaggtaaggattagttatttatattttttttgtggtggaatgttattagttaaggtaaggattagttatttatattttttttgtggtggaatgttattagttaaggtggggtagggtatttttattttttttgtgattttttagttattttaggttatttgggtatatatttgtaagttataggggatgtaatggtttagtttaggtttagagttttgatagatttatttttgtttttatttttattttgtattttatttatttgtttttaaaattttaaattaatttttttgtttttttttttggtagagagagtttttttatgttgtttaggtaggttttaaatttttgattttaagtgatttgtttgttttagttttttaaagtgttgggattataggtgtgagttattatatttggtttgtattttattttttattatggaaattttttaaaataaataaaagtatataggatggtataatgaatttttatgtattttttagttagttttgatagttattaatatgtggttaagtttattttatttttatttttattttttttttatattagagtaaattttggatattgtattattttgtttataagtgttgttgtttaaaagagattattttattttttaatagatggtaattgtgttgtagaatattattatgattagttgttatttgtgagtttttttgttttttatgttatattttgttttgggattgggtaagtttagtatttgtaagtttattagtagtagtggtaatagtagtggtggtattagtagtaatagtagtagtggtggtagtaatggtagtaatgatagtagtagtggtggtggtagtagtagtagtgatggtggtagtagtggtagtagtagtagtggtggtggtagtagtagtggtagtagtagtagtggtggtggtggtggtggtagtagtaatagtagtggtggtggtggtagtagtggtggtagtagtagtggtagtagtagtagtggtagtagtagtagtggtggtggtagtagtagtggtagtagtagtggtagtagtagtagtgggggggtggtagtagtagtagtagtagtagtagtagtagtattgttattattttgaggattgttttaaagttatttgttgggtttgttgttagttgttgatttttgttttgagtttatagtttgggtttggattttttttattagtagtttttgagggttttttatgttttattagtaatgtgtttttagagttttgatagttttttttttttgattgtttttatttaggtattggttttgttatttttttattttttgtgttgttattttttttaattaggttttttttattttttatttaagttttagtagtagttttttagttagtttttttattttagtgttatagtatttgttttaagaataattttgattatgttattttgtttagaaattttaaaagtttttttgttatttattaaagaaattttaagttatagggttaggtatggttttatttgatttttttggatggatggtgttatttttttttaggttttggtatgtttatttggagttgttatttttgtagtttgttttttttgtatgttttttttttgttattagtgtggttttggtttagaaggtatttatagagttagttttggtagggttggggtttgtattagttgagtttaagttttggtggttggttgtttttaggatttttatttgttatttttgttatgtatagggatgtttttaggaaaaggtggaatggtggtttttggaatgatttgttagtatattgtttagtttttttttgattgttttggggattttgatgattttattttagtggagatttagttagtttatatatttttgatttttttgtaggtttggaggttgttttttgtgttgatatgtgagtgtgtattgtagttttttatagatttagttaaggttggagagtttttataaggattgtttgttttttaggttttttttgtattagtatatagtttggtttttttgggtaggggttgtgggttttgtagaggaaattgttagtagtttttgtagttatttatagtgttaagttatgattgttttgtttgtttttgggtttttttagtggaggttgatttatagtaggggatgaggttaatagtttagttaattttattataggttttgttggtttatgaatatttttgaggggatttgtgttatagtgggtaaggaagaagtgtttgtgtattttgaggagttttaataggttgttgttgtttttgtggttgtgggggtaggagtttttagtaaagttggttttagttgggtttttttagtgataagtttttatagttgggtataggttggaatttgggattgtgattttttttatttttgttatagtttttaaggattatgttgggtggttttggttgagtatgaatttataatgggtattgatttttgttgttttagttaggagtgaatagagttttatggtattattgttatgtggttagtagtagtttgggtagagtttaagtgggtgtagggttaggatatgtttttatttattttttttgtatagggtgttgggttgggattagttgttttgatttttggttgtattttaggagaagtatgatagtagggtttattaagagtgatttgttgttttttttgtatatgtttttttgtggttatagtgttattggtgttggattgtggttattgttttattgggggagttaagatgattagatttatttgtaaaaatgtgggttttagtgttggtaggttttgtattatgtttaaaataagttggttattattaagttttaaggtgagtgattataggttgttaattggaaaaattataagtttattaaaggaaataatttttagaggaatttattagagtatatttatgattggaaatatatagaatgtagagtgttgtaaattttttatgtaattgttataatttgaatgagaatggatgtataagggtttagtgttgtagttttggttatgttattaatatttgtattatgttgggtaagtggtattattttttttattttttaagttttggtttaaatgtgattgtatttatttatttagtttttttttattgtagtaaatgattgaatagtttagaggttataaattggttgttttttggttaaattttgttggtatttgtttggtatagtatttaatattttttgagttaatatttaaaaataaggagatttggttaggtgtagtggtttatatatgtaattttagtattttgggaggttgaggtaggtagattatttgaggttaggggtttgagattagtttggttaatatgatgaaatattgtttttattaaaaataaaaaattagttgggtgtggtggtatgtgtttgtagttttagttatttaggaggttgaggaaggagaattatttgaatttgggaggtggaggttgtagtgagttgagattgtattattatattttagtttgggtgatagagtgagattttattttaaaaaaaaaaaaaaaatggagattttatataaagttttatatttttagttttttgaaaaattggaagatatgaaggttagggttaggatttattgtgagtttgttggttagggttgggggtaggttttgtgtattttgttttgagtgtttagttttattagttttaagagtattttagtattgatattatttattagtatgtttatattatttattagtattgatattatttattagtattgatattatttattagtatgtttatattatttattagtattgatattatttattagtattgatattatttattagtatgtttatattatttattagtattgatattatttattagtattgatattatttattagtatgtttatattatttattagtattgatattatttattagtatgtttatattatttattagtattgatattatttattagtattgatattatttattagtatgtttatattatttattagtattgatattatttattagtatgtttatattatttattagtattgatattatttattagtatgtttatattattattttttttatagtaaagatatttatttgtatttagaaaataagggatatatttagaggatgatattttaagatgttttaagaaagatattttatttatttttgttattgattagggttttgtaggtatgggtttgtgtttttggtatgttaagtgattttttgtgtaggtattggggttgtagtttttgtgttttaggagtttgtagttaggggtgggttagggttggaggtagatatatatgttagtatttgtgatattgggtgttattgtaggaaaaggataatgtgttttgggagtttaggggagggtttatttagtttattttttgagtgagatttttttatatgtttgttattttgtgttttaattatttggtgatggtgttttttgtattttttgttagtagttagttttttatagatgttttaagatttattttttttaatttttagaattttatttggtatttggtgatggttgagtaaatgtttgttgaatgaataagttttagtttttttattattatgtgattggatgatttttaagtttttttatattgtaaaatggatgtttgaaggagagaagtttgtaatttgaatattggtttttataatgttttttatattgttgggtaatttgtttttttttaaggttattgtaattgttggttttgttgaataatttttttttggaattttgtttttggtgtttgagttggttttgggatatgttatattagtggaggtaggtaattagatattggtatgtatttttttaattgtttgtatgtttgtatttgtttttgtttttatgatttaagtgtttagttttattttatattatagttttagtgatttttgggtagatgtatatttttgtattttgtagggtgatgttagatgttatttgattgttttatgagtatttttataaagtaaatgtagatagttttagtattatattataaatttgagttttgttagtttatatttttagtttgggagttatttttattaatgtttaagttgtttttaagatttttgtttggttttttagttttttttgggtttttttttttttaggtttttttattatttggtatttgattattgtggttattgtggttttgtttttatttttttgttttatttttagtttgtatagttagtaaggtttaattttgttatgttttattttgaatttttgtagaagtttttagtggtttgtttttggttgtgggtgtttttttttttaattggttttttttgttgttttttttagttgattatatttgtttgttggtttttagaggtgtttatgagaaatggtgatattttttgtttttgttgtagtatattgttattttttttgatttttggtttaggagtttgattttattttatgtgattgggtgtgggttgttatagatatgtttggttttttatattagtttgttgagggaggtttttgatatttaggagtaaaaattgtttggtttttgggggtggatttggtttgtgttatattattaggtagtgagatttagtagtttttatttttaaatttagttgtatattgtaattatttgagagatttggaaataatattaaggttttatttttgaggttttgagtttattagattgggttgtggtttgggtgttggatttttaaagttttttagggaatgttggtgtgtagttaagttggagtttaattgttatagtgattttgttatgttgttaggaagggtttttttttattagttgttttttagttttaagtgtttagtaggttttgtagttttaggatgtggtttttttatttatgtttttgtttatttgatttttgatgagaaattagtttttgggattgagattgagttagtttaggggttttgttaggttttatttattgttgaggggtaggttgggtttataaggtttatatataggttaggttttttgtttttttggtgtagtttaggatttgttataggtttattgaagttttaaggaattggagttgttttgttttggatattttttttattttatttttttgggatttttaagtaaaggaagagggtagtagtaggatttttaggggagtagtgagggagttggggaaggttttttttttggtattttttgtgtattttgtttattgattgtttgggggtttgtttgttttaaaatgtatttatagttttaaataagaaatatatttgtatgattaaaaatttaaaagagagattgggtgtagtggtttaggtttgtatttttagtattttgggaggttaaagtaagagaattgttgagtttgggagttaaagattagtttgggtaatatagtgatatattgtttgtatagataatttttaaagtaaaaaataaatttaaaagagttaggtgtagtggtttatatttataattttaatattttgggaggttaagataggaggattatttgaggttaggagtttgagtttatagtgaattgtgattgagttattgtattttagtttgggtaatagagtgaaattttgttttaaaaataaataaataaaaataaaatatttaaaagatgtaaataggtaaatagtgaaatgtttttttttattttagttttttagttatttagaggttatatttggttagttttttgaatgtttttttagagatagtttatgtttaaataagtaattgtatatgtttttatttttatttttttttttatatataaagttgtttattttatattttgttttttgttttgtgttttttatttaattttatattttagagattatttttatatgttttagtaattgtatagtattttattgtgtgaatggattataatttagtttagtagttttttgttgattgatttgaagatttttttttgatttttggttataaattatgtataaattatatatatattattttgtttaaggatgagtttatttataggatatagtttttgaagtagatttgttgatttagtgttttgtgtttttataattgtaaggtatgttgttaaaatttttattatgtggattgtattaatttatatttttaatagtagtatgtaagggtgtttgtttttttatatttttgttaatatagtatattataaaatttagaaattgtttatggatgttgtatataaaaatatatataaaaatagagagaataatgattatttatgtatttattatttatttttaataattattaatttttggttaattttattatatttatatttttttattttttttagatattttttattttgtttttttagattattttgaataaaattaagataaaatattattgtatttaatagaatgaaattagatttgtgttttttattatatataaaaattaatttattaataaaatggattaaagatttaaatataagatttgaaaatgtaaaattattagaagaaaatggtggaaatttgtatgatattggtttgggtaatgattttttgtatatgattttaaaagtattggtaataaaagtgaaaataggggttaggtgtggtggtttagtattttgggaggttgaggtgggaggattttttgagtttaggagtttgagattagtttgggtaatataaggagattttatttttataaaaaatttaaaaaattagttgggtgtggtggtatgtatttgtggttttagttatttgggagttgaagtgggaggattgtttgagtttaggtgttagaggttgtagtgagaaatgattatattattgtattttagtttgggtgatagagtaagattttgttttaaaaagtaaaataaataaatgaataaataaaaaaataaatatgaatagataaatgggattattttaaatgaaaaagtttttatatagtaaaggaaataagtaatagagtgaagagataatttgtgaaatgggagaaaatattattatatttgaggaggggttaattttaaaaatatataaggaatttaatgtaatagtaagaaaataatttgttttttttaatgggttaaagattaattagatattttttaaaagaagatatataaatggttaatgagtatatgaaaatatttttaatattattaattattagggaaatgtaaattaaaattatagtgagtttttatttgatatttgttagaatggttattattagaaagatgaaaggtaagtgttggtgaggatgtagagaaaagggaatttttgtttgttgttgatgggaatgtaaattattatagttgttatggaaaataatatggagtttttttaaaaaattaaaaatggaattattatatgatttagtagttttattattaggtatatatataaatgaaatttggttggagtgtagtgatgtgattattgtttattgtattttttaatttttgggtttaaaagatattatttaaaagatatttgtatttttatgtttattgtgttatttataataggtaagttatggaattattttaagtgtttattgatagaggataaagaaaatgaggtatatgtatataatggaataatagttttgtaaaagaaggaaattttgttgtttgtgataatatggataagtttggaggatattatgtgaagttaagtatagaaagataaatattgtatgattgtatttatatgttggattttaaataattgaatttataaaagtagagaatagaatggtgattattagggttgggggttgggggaattggggaaaaaatagaaaataaattattgtatttatgatagtttattttttgttttttgttagtatgagtggtaaaaagttgtttttttggatggtttttattgatattttttttattatgaatgagggtatgtgttgttatttatttaagggttatttgtattttggtttttgtgaattttatttttatatttttttagtttgttttttgtttttttttggggtggagttagggtaaaatatttggttttaggagtaaggtgggaggtggtagggaggggaatagagagtgaagagtaaagaaaggggtgtgtgtttgagaggaggagggtgggaggtggggagggtggaagttttttaatgggaggtaatggaataattttttttttttttaggttttgttttttttaaagagtttaggaaaggtagagtagatttttattattatgtgtgataattgttagataaaggagttggtgattataggtgggtttgagtgtatttttaggggtaaggttggagaggttgttttagttttaggggttattgattatagtagtattagtggtagtttatttgttttttgtgtgtgttaggagtgtatattaagaatgttgtagtttttaggtgttagagttttgttttaggtttattgttttggtttgattttggagattaagttagtgtggtttttaagatagtttaaggagttttttagtaagagatagttggaaatttggggtgaaattttttattgttttattttgaaatttattttgattttttttggggaattgttagtggtttatatataaatagttagagttatttttagatttttgtagggttagaagaggtattttaggaattgtgataagatgtttttggttgttttttttttttttttttttttttttttttttttttttttttttttttttttttttttttttttttttttttttttttttttttttattaattgagtgtttgttatatgttaggtttttaaaattatttttttttggtttttaaagatgtgagaatattaatttgtgggtggatattttttttttttttttagtgtgagtttgtaggaattatggttaaggttagttgtatgtggatggtggtatgggttttgtagtagttttggtttgattttagttttagtgagtttttattgattttatttattttattttggtaggaattgggtagttgattgttttggatttgatttatatttttggtgaaaaaagttagttagattttggagagtttatagatttaatagtttagtattttatatgatttgagtttgaaaatttttggtttatggttaggaagtagttgattattagaaatgttatgtgggtaatttttgtgtgtgttttaatatttaatttttttttttgtttatttggtttttagttttagtgagataggaggtttttttaagggtttggggaagattgggtatagaatggatatttaaatttaattgagggatttagattgatttagtttattatggaaattagtagttatttttggttatttaaatttaaattaattaatattaaattaagagtttatttttttagtggtattagttatatgtagttagtggttgttatattggatagtgtagatttgtaagatttttatttttttaggaagttatgttagatagtgttgttttaaattattttggattatttttagttagttttagttttttagagaggatatattatgtttgtgtaggggaagttatttaagttttaggggtagatagattatagtttgtgggttttattttttttgttatttattttttgatttgtttttgagtattattatgaaattaggataaattttagggagttttttaattagggttgttttggggattttagatattatataggattttgttattttttttttgggatagttgtaagttttgttttttttatgttatggagttgttattgtttttgttggtagttagtaggtatatatttttttggatatagtttttttgggagtttataataggaaaggtagagggtaggaatggggttgatgtggtaaattttggaaatttatgtggtgagagatattgtagaagatttttttaatattagggggtgatgtatagttttttttattttaatgattggaatatgagtttttgatttattatgttttttgagttatggtaggtttaatttttagttgttatggttgggaagtgaggagtttttttatatagtttttgttttagatttttttgtttatttgttgttttttttttattggagggttttttattggaagggtgtgaaggttgatttggtttttttttgtttttaggtttttttttgtttttttttggagtagggtagggaggtatggggtggagggatttggttttagtagaattgggatatggttttggatgtgttgtttttataggtatgtggagttggttttttattggtagattatgaagtttaatttgtagttttttatgtttggagaaatttttagtatggatagtattaagtgttattttgataaggagattgttttttttattatgtttagaaagggggttttaagtttttatatagattatgagtttattttgagtttttttttttatgaggtttagatggtgttattttagtagttatatatggttggattatgtatttagattttttatttgtgttttttaattatattgaagttatagttgggtttattgaggtgttattttgtttaggttagtatttggttgagttgggttggagtatatatttggtgtgtagggtgaagtagtttattttgtttggttttgattttagatttattttatttgtagtaagatttttggttggttttttttgttttgggtgttttttatatgtttattatggtaaaaaatattattatttttatttatattatagtattttttagagagagtgaggtgtagggatttgagggttaggttagtatagtgttggttttagtatggagggaagttttgtgggttatggtaggttagaagggaatttgagttgggtatgaaaaggatgttttggggttattgttagtgggtttggggttgagatgagtgattttgtttttggttttagtatttagttgttttgttgtttattttgggagggtgtggtgttttggatatgttgaggggttttgttagtattaggaaggtttttgttttttgtatttaggtttagttgagataggtttttgagttttggtttatgttttggtagtaattttattttttttaaggaggggaggaggtagtagggaagtaattttgggtttttagaaggtttttttgatggttaggttaaggggaggaagaatttttgttatgttttagttttttttaggataatttgttggaatgtagtggtgtttttagggtattgtgtttgttttgtagttgagggatttttatagtgtgttttagatggtgttagaggaagttttagagtttgtaaggtgagagaaattgggttttggatgagaagtgggtagttgggtttttttttattttgggggtttttttggggaaggtattaggtgagggggagtgggtagtttggtttttgtaggttttggggagtgagagtattttttttgttttgttttggtaatttagttttgtaatgggttgagtatattaagtttgttaaatttattatgaggttattttaggaattttggagttgtgttttaggtttattgttgtttttggggagttaaattggggggtttttggtggtggtgagtgtggaggaaaagttttgtttttatggtgtaaatttttaggttggggttttaggtagtttagtgtagagattttaggttggagggttgtagatggtttttggaggtagtagggtaatgttttgttttagtttttatgttaaattattgttatagttattggtgtttattattttttaggtattggttaatgtttttgatttagggggtttaggagttgtgggttaggtagtgtttttttttttataaggttaaatgtgggatagaggtagggatattttaggatgtgtttttaggtgtgttggtttttagttaatggtgggtttgtgtttagtttagaagtggagagtttggggtattttttttattttgtggatgatgtgattgttttggaaattgaggtgaaaggtttagtagaatttttttaggtttttttagagttatatgtttttattattttaggggagaattatattgggataaatgtgaagaaggtttttaaggtaggttattgttttttttttgtttaggttggttgaggtagtgttgatatgagtgtaagtgtagggaggatatagtaggaggggtagatggtagtagttattgtatggaggttgaggttatttttagggttttgaatttaatttgatttgtatagatgtataggttaggtatggttgtttttttttattagttttttagaattttttgaaagttagggttatggaatttatttttgtttttggtagagtatgttagttataggtattgtagtgtggagggagggtgtttttgggttgggaggtttatggttttgggtggttaggaattagttgggaagtgttatatggattttttatgagtttataattttatagttttttagtaggtatagaattgatatgaaggggtagtaaatgggtagtttggttttgggtgttttttagatgtggaataatagtaagttatttattagatatttgtgggggaagattagtgattgttatattattgaagtggagtttggtataggggttataggtattttggggattgtaggaggggttgtgatttgtttggggttggtttaggaagaaatttttagagttaaaggggtttatgtagggtttttggtgttttgtgattgttttggttgaggtttgggatgtgagggagatgagaagtttgtgtaagttagatgtttgggtttaattataggaggaaattgtttttgttttttttttttatttttttttttttttttttttttagagtttagtgaggttggggattttgagttgaattttattgggggtgtttttggttttataagttaggatttgttgtgtgaaattgaagatttgtttttgttagtggtgttatatattgaggttgtttttaaggtgttgtaggtggagttgggtagtggggtgggtttagagaggtggtagggttgggatattgagttatttttaggtggtttagtgataggttttttgggtgttttaggggtttgtttttattattaatgttttagttttttagtttggtttgttttgtttggggtagaaagttataaattttatttagatttggaatgttagttagtttttagttatatggtgtatgaaggagagtttagtttttttttaggaaaggtttgaggatgtaagttaggtattgttggtttttttggtgtttttataatgagtttgtttagtttgttttggtgaaatttgttttggtgtgtttagattagagttttgaggttggtggaggaaaagtttgtttggtgattttggtttggtggtgttttttgttttttttattgttgaggtagtttagtttttttttatagttaaatgtaattttttattagtattttttgtgttttttattattattggatttagaaatagggtgtgggttttttttttagagttgtttgaggtaggaagagatgggtagttaggttgggtaggaagtttttaaggttgttgttgttttagttgtatttttattttttttttattttttggaaggtttagatttttttagggatttgttattagatggtatttggttataggttggtagtttaaatttaaggttttaaaaagaaaatttaagatttattttgatttaaatggtattttttattataaaagtaggaaaaaaagtagttaagtattattataattatatttaaatgtagtgggtgatttggaataagataaagttatataaattattagttatttgtaaaatgtttgtagtgagttgtatattattgtttttttattatggtatggttgtagttttttggtggattgtatatgtgagattttggttatgtttggtgattatattttttttttggttgttttttattgaggtttttattttgtttgtttatttgttttttgagttagaatattgtatatttttttttttgtattaaggagtttagggaagataatttaagttatgtatatattttattttgttagtgtgtattttttttttgtaggaaagtgggtttttttttttattttagggaggttttgtttttttatttgatggtttatagttgggtattttgaaatttagaagttatgatagtgtgtattaaattgttaatgttattgttaagtatttgttatataggtttggagtttaatatttttttttttagggtttatttattttttattatggattttgaaattataaaagattaaggttggtgtttgggttgggatggggttgggggtagggtggtattagtatttttagtgtttatattatgtttagttaagaattttttttttaaatgaaattttatgtaaaagtttagaatatagaataaattgtgattgttttagttatttagagatttttttgttaggtatttttgttttattttgtttttttttatattttagttttttgtatttttagggattttttgggattttttagagtatagttagaagtttatagattttagttagtttttttatttgatagaggagagattggaaggggtagggtttttttaaggttatatggttgatgggtagtggtattatatttgattttttttgtttagtttttagtttgtggtgtttttttattgtgaagaataattatgttttataatggaaataattgttaatgttatagtattgtaagataattttttttttatagttttttgtattttatttttttgagtttttaaaaataatgttgggatttggggtttgttagatggttttagattaggggatgtagagttgttgaaatttaattttagattatagttatttttagagttttaagggagatgtatatgagtaataaagataaaataaagtaaagtggttttttatagggataagtgtttttttttagttagggtaggaagaatggaatgtaaagagttttttttagatggggatatttttttttttgttttttttttttttttttttttttgtgtgtgtgtttggtatgggaggaggagtagattgggggtggggtgggggtgggggtgggtaaatgaggttgagtttgtagtaggggatagaaggaaggggtgggggaaagattatgtgggtgtaaaggagaaatttggttataatagattttttttttttttaatttagtgatttggtggttttttttagttgaagttgtttagagggttatttttttagtttggtttattagtttttttttggttttttagttttttttattttttttggagtatttttttttgttttttattttttagatttgggttagggtatggggttttttgatttatgtatttttttatttggagatttagtttttatgtttttaattttgagatttttgtggttgtggttttttatttgtttgtttgtttttggattttagatggtttttggaagagttggggtagtttaggagtgattttggttaggtatggttagtttttagtttttttgtaattttaagtgtttttagtgtttatttttttgagtgttttttggggtaggtgtttttttttgatattgagtttttgagtggttagttttattttttgggggagtgtagggtggatattattttggaggttttgtattgttagtatttggagattgttttggagttggaggtggaaaatggtgtttggaggtaagggtgttgtgggaagagttattataataaattatgtatatttgtgatgtatttatttatattatatatttatttagagatgttttggatttaaaattattgaatttagaaaattagtattttataaaatttgtaaattatagaaaagaaatttaaaatgatgtataatttattttttagggatgatttattgataatattatgtatatatttttttagggtgtgtgtattaaagagatgtaaattagtataattatttttgaaattatgttagtattagttagtgtttgtttttttgagtatatttttagggaaatttttatatatgtatagtgggagatgtgtgtttatgttggaatgtttagattggattgtttttataggaaaaattagaaaaaattattgtttgttaataggagaatggatatttaaaaagtgtgatatatttaaataagtatatattattgtattttgggaggaatatgttagaggttttaaaggtattggtagtattttttttttttttttttattttttttttgtttttttatttttttttttttttttttttttagtggaaaattttttatatatataaaaatagaaagaatagtataataaatttttatatatttttttttttttttaataattgttaatttattgtaagtattgttttatttatattttttatttttttttttttatttttttttaaattatttttaaataaaatatttatttttttgttgggtatggtggtttatgtttgtaattttagtattttgggaggttgaggtaggtaaattatgaggttaggagtttgagattagtttggtaatatggtgaaattttgtttttattaaaaatataaaaattagttaggtatggtggtgtttgtttgtagttttagttatttaggaggttgaggtagaagaattatttgaattttggaggtagaggttgtagtgaatgaatatatatatatatttatttttttaagttggttggtgataatattttgtttttaaagttgtgtggaggtagtatatagatgttgttttattatttgttaaattatatatatgtttaaattgtatatatgttttatatttatttttgtatatatttggtgttttattgtaaaaatatttaaatgtttatttaaatttttgtggatgtttttgaattattttttaaaaagattgtgttattttatatttttgtttatagtgtgtgagattagttattattttatatttttattatgataaatgttgttggattttgtatatttgattatttgatagttgtttaaatgtttttttttgtgataataaatataggtttaggtatgagtttttgtattggttttttagggtaatttgtgggtattagatgtgaaggttaagtttgtttgtagtttaggggaagggttttttattaagtttgtgtttattttttttttttttttgtttttgtttttttttttgaaaggattttgtattattagaatgtttatagtagtaggtgatggaaatatagatattattaatttaggtaaaaaagaggaagtattggtttatgtaattgggtatttttattttgttgaatttaagggtttaatatttttttttttgtttggttttttgttttttttttttttttatttttttttttttttttttatttttattttagttttaatttatttattgttttttttttgtgggttttttttttttttattgataagggttttttgtattttgttttggggagaggttatttagagttttaggtttatatatttttattttaataatttttgagagttaatttggttttttgtagagataggttttgattgtttttgtttttgtgtgggttatgtatttgtttttttttttgttgggtgatagggaggatttgtttttagaagaggtaattatgttttgaaattttaagttttgttgtttttgtgtttttttttttttatagtaatttgttatagttttattaatgtaatagttttttagatttttttaagaaaatgaatttttgtttttttagatgttggagtttttttttattttttgagtttttttttgtttttagtaatttttgtttgtttagttttgtttttgaatggaggaggaagttgatttgtataaggagttggtgttgtaagttttttttgagtaaaagggggtagatgtggagagtatttttattttaagggatgaagtatatgtgagttattatttttagagtatatagttagtttgaatttattagagaaagggatttttggggaaaatagttttaaataaatagtggagaaaatttatattgggtagttatataaattaatttgtgtttttatttataaataagaatgaaggaatagtatttttttggttgttttttttttatgatagttgagaggtttagtgttattgtaggttttgttttggtttttttttagtgtgatatttatagtttttagtgggggtaaatattgtggtagtttagttttttttttaatttttaattttaatttttattatttgtataaatttatggggtatatgtgtaattgtgttatgtgtgtagattatatagtggttaagttagggttttagggtatttattatttaaatagtatatattgtatttatgaattaattttttattatttattttttttttatgtttttatttttttgagtttttgttgtttattattttaatttttatgtttatatgtatatgtttttagtatttatttgagtgagattatgtgatatttgatttttgtgtttggggtagtttatttttttatgtgttgttttgagttttggggttggagttttgatttggttaagttaatggatttttagtagtgttttgtttagtttttttgttttttgatgtttttattttattattaaggattgtattgtatgtaatttgtgtagggattttaagtagtagttttgtttttttttgttttattagttaatttgattatattattttttttttttatttttttttttttgtttgtataatattttatttgttttattattttttattttaaaatttttataaatagggtatttgttagatattatatttttttgtatttataatttgtttgtttggtataaagttagttttttgtttgtgttagttttgaatgtgttttttttattaagtttaattattttttagtttaattattttgatttaaagtgagatatgtatgatttttttttttatttgaagatttagaggttattgtagggttattagttggtttaattttaatattgttgtgttttaaggaatagggaggtttgaggagagggagagagatggaaatgattagtaagtagagtagttaaaatgtatatagtatttattagttgagtttattattgtatatgattgttgtttatggtattttaaaataattatagtagtaatattaaagattattaattataggttattataatagttatagtaaaaaagtttgtaagatatgatatagagatatgaaatgaggatatgtaattggaaaaatgatattgataggtttgtttaatgtagtgttgttataaatttttgatttgtaaaaattatagtatttgtgaagtataataaagtagagtataataatatgaggtatgtttgtaattgaattttttatataggttaatttagattttttttttggttaggtatagtggtttatgattgtaattttagtattttgggaggttgaggtggatggattatttaaggttaggagtatgagattaggttagttaatatggtgaaattttatttttattaaaaatataaaaattagttgggtgtggtggtgtatatttgtaattttagttatttgggaggttgaggtatgagaatagtttgaatgtgggaggtagaggttgtagtgagttgagattgtgttattgtattttagtttgggtaatagagtaagattttgtatgttttattttatttttttaaaaaaagattttttttttttttttagttttggtagtttgtattattttaggaatttaggaatttgtttattttatttgtgatgtaatttgttggtatatagttgttagtggtattttttgataattatttttatttttgtatgattagtagtgatgtttttatttttatttttgatttttttaatttgaatttttagtaaattttttttggttagtttagtttagttaaaggtttattaatgttggtgatatttttaaagaattagtttttgtttttgttgattttttgtaatgtttttttattttttattttatttatttttgttttttagtttttattatttttgtttttttatttgttttgggtttagtttgtttttttttttttagttttttaaggtaaaagttgaggtttttgatttgtaattttttttttttgtttgtttaaagaaaattgtatttataaatataaatttttttttaattatttttttagttgtattttataattttttatatattatgtttttatttttattgatataaaagtattttttaattttttttgtggttttttatttgatttgtttatgaatgtgttatttaatttgtatatattttgttttataaatttttttttgttgttgatttttaatttgattttattgttgttggagaatttattttatataattatagttgtttaaaatttattgagatttgttttatgggttattttggagaatattttttgtgtatttgagaaaaataatgtattttgttgttattgtgtagagtgttgtttgttttgtttggtttatagtgttgtttaaattttttattttaatgtttattttttggttagttgtttttttattattaaaaatgggttgttgaagtttttaattattattgttgaattgttgattttttttttaattttgttagtttttgttttatgtattttgtggtgttgttgttagatatatatatgtttataattgttatatttttttaatttatttttttataattataaaatattttttattgtttttaataattatttttgttttaaagtttattttatttaatatttatatattttttggagtttttttttgggtattgtttgtatgatatatatttttttattttttttttttgaaattatttgtgtttttgaatttaaagtgttttttgtaaatagtatatatttggattatttttttaaaatttattttgttaatttttgttttttgattggattgtttaatttttttatatttaatgtaaatattgataaagtagaattttattttttgttttgttatttgttttttgtatgtattttgtgttttttgtattttttgtgttttttgtatttttttattattgtttttttttttgttagataggtagtttttagtatgttattttaatttttatgttttttttattttttaaaaagttatttttttattggttgtttagggttttatagtatattttaattttaaaatagtttggtttagattaatattaatttaattttagtagtttgaaatgttattgtaatatagtttagttttatttttttttttttttttgtattattattgttatataaattatatatttatatattataggtttattaagatagttttatagttattggtttgtatagttgttttttaaattagatagaaaagtaagtaaaaatatatttattttgtttttgtatttatatatgaatttattttgatatggttatattagttaaggtttaatatttattttttaataatttattaagatatttattataaagaattaggttatataattatagggattagttaggtaagtttaaaatttgtagggtaggtttttaggaagggtatgttggtatttttggggataagatgaagatgttataaatatatggaatttttttgtttgggtaagtttatttttgtttttaagattttttagtggttaggtatggtagtttatttttgtaattttagtattttgggaggttaaggtgggaggattatttgaggttaggagtttgagattaatttggttaatatattgaaattttatttttattaaaaatataaaaatttgtttggtatggtggtatatgtttgtagttttagttatttgggaggttgaggtagtagaattttttgaatttaggaggtagaggttgtagtgagttaagattgtattattgtattttagtttgggtgatagagtgagattttattttaaaaaaaaaaaaaaaaaaaaaaaagattttttaattaattgaattaggtttatttagattatttaggataattttttttatttaaatttaattgattatgaatattaattatatttataaaatatttttagttgtttagatatgtaaagagtttgtttattaagtttttgtttttataataaggaaagattgaataaattgaaataatgattttttttagatttattagagagttgaggttgtaggataagtggttattttaaaagttggagatataggtaaatattgagaatatagattagtttatttgaagtagaagaatatttaaatggtagttttaataaatttttggtggttaagtgtaggttagtttaagagtttaaaaattttgggggtttagtaggtttttatggtgaaaattggaaaaaaaatttttttttgtttagttagggtgggatggggaggggaagtaattattttgaaatatgtttagaggaaaagtgaaataagttattttgaaataagtttagagtgtttttgtaataattttttttatatttgagatttttattttttgagtaattataaatggtattatattttaaattttgatttttatatgtttgttgttagtatataaaaatgtgatttatttttgtatattgattttatattttgaaattttgttgaatttatttattaattttagagtttttaaaaatatagatattttgggattttttatatagattgtatgttatttagaaatagggatagttttatttttttttttttaattagtatgttttttgtttttttgtgttttagttatttttttgtgtatgttgaggtatagaagttttatgtgtatttatagagtagttaggtggaggttagaaatttttatttgggtgtgtttatgaagataattattatatttattaatggtatgtttttgtttatttagttttattggggtaaggtgagtgagtttatagtattaggtagtagtttgtagtttttagttatagaggtttatatagaggggggtattgttttttaaatatttttatagaatagagatatttagttttttttttatagtttgttttttgtttgtagtgtgtataaaagttttttaaaggagtagtatatttggtttagtttttttttgttttgtttttagggaattttagttttttgattaagaaggagtttttggtgaatatagttagagttttttagttaatatagtttatgattggtttaggtagttgttggagtttagttgtggtgttgtttttgtttgtggttgattggggagttttgagtgttatgggatataaggttatatttatgtgtattagaagtatttgttttttgttttttattttttggggtttttaagggtagttttttttgtttagataattttttaataagtggtaaagtttatttagggttggggaggagaggagaagggatttgtggtttatttttagaagtgagtatttagttttgttggttttgttgtgggttttagtttgttagtttttagtattgtatgtagtagtgttgagtattttttggatattggtttattttgggagtttagtaagtgataataggtttatttatgtgtttgttagttttttggatattaagtagaattttgtatggtgatagttttttttaaatatggtttgttgggtttaagtgaggagtgttagtttaagttggagttgattgtttatatttaggtgagtaaggtaatgtagggtttgagtgattgggaaggtattttgttaattatatgtatttgtgttattagggaggttttagtttaggttatattgttggtttttgtgggtggggaagagattttttgtatttgggtttggggtttttatttttgttgggtttgttttttagggatatatggttagagagtttggagtaggtttggggatgtgttttgagatttattggttatgtttggtttttggtatgagtttttgttttttttaggttattttttgtggttgtaggtgggtttagttttttgatttgtttagagatttagagtagagttgttgtttatagtaggtattgtgttaggtattatttagggaggttaattggtatttaggttttttgttggaggttattagggtggaatatgtttagttatagggttgtttttagttgtttttttgtggtttttgtgggaaaagaaattttttttttatagagatttgtaaatttaggttttagttttttttggtaaatatggggatggttggtttgagttttgggatgatagataggtaggtttaggtgtggaatagattttgtttagggagggtttgatttttagggtagtagttttattagaggaagtgtgtagtttttttagaggttttttttgaggggtttttttttatgtgggtatgtttagatatttggggtagatttagatagttataaggtttgaggaaagggttaggttttttggggttgagggtgggttgattggttgggtttattggagggattggagatgagtttggttagaggttaaggttttatagtaattttttgtgttgtggaagattatttgggtttatttttagaggttttaggtttggtttgatttttggatgggtttttttataggaagagttgatttatttggtttttttttgttatgtgttaggtatgaagaagttattggttttaggtatttttgggaagttttagggattgtaagtggttattattatttttaaggagagttttgattgtaggtgagtttagggttggtggtttgggggtggtagtggattgaggaatgaggtagttgtgtttaggattagtatggtattgtggtattagtttgtgtttatttgatttttgtaggtaggaaaatgttatagtgttattgtggttatttattatttttgtggggatagttttttttattttatttttgttttttgtgtggtttttttatatatatttggaggtgtggtgttttggtaggtaggagatggtaggggatagggttgtaggtattttgggtttgtttatatgaggtttagtaattgggagttatgttagtatgttgttggttagggatggtttgtgtagagtttgaggttttttttagtattatgggtgggtaggaaaggtgggtttgtggttggtagtttaatgaaataggagtttgaggatgaagtttggtgtttgggtagtttttgtatgtttatttaagatggttttttgggtagggttaagggtggtgtgttatatagtattaatgggtataggatagtgtttttagtatagagtagtggttaggttatttaaaggagttttgtttggattttggtttagtggtgttattgaggatttgtgtgatttgttagtttatttttattaattgttttttaatatggatttgttttttttttaagtttgagtattttgggagtttttaaaatagtttgagtaaaaagattagtttgtaagttttgttttttttattttttagggtagatgaagttggatggggtgtattttgttgagtttttgtgtggtttaggtggttagtggttggttggtgtgagagatgggagtgtgtgtttttataggtagatatggggataggtagagaggaaatggtttttgttgtttattttttgggttttgagtgggtgtgtgggagaggttgggattgtggttttttttttttagtttggtttgttggagtggaggtttttgatggattaggtagatgggtttgtagtgagggagaggttattgtagatagaaggaattgtgtaggttaaagggtgggaggaatagtttaggagtagggagtttttagggattattgatagtgtgtttgggttgatatgtggagagtgagatggggtgttttatagattagatagtgattagtaaagttattatgtgtaaggatagaggtaagatttagagtgttgtttatatagatatatatatatatatatatgtatatatatatatatatgtatatatatatatatatatatatgtatatatatatatatatatgtatatatatatatatatatatatgtatagatataaatatatatatatatatatatgtatatatatatatatatgtatatatatatatatataaatatatatatatatgtatatatatatatgtttatatatatatatatttatatatatatatatatataggtgtgttagaattagttagtattggtttaggagaattgattgttaaatatttaggaattttgtaaatttttaatttgaaattaaatattataatttaggattttttttttttggaatttttattgtgtggatattttattatttaatttagtgaagtaagagggtttaatttagaaattatggttatgggtggaaggtgatttatgaatagtttataaggtattaattttttattgtggaaagttagtgtgtatttaatgttggatagatgttagtaggaaaaattggaaatgggtttgttgtagaattttgggttagagatggggagtttgggttgggtttgtgtttaggagtaattatggtatagagtttgtgggtagggagttttgttttagagtttgtttgggtttttggggaggtaatttttgtagttggtgggtggtttgtagttggggatgtttgaatggtaggggtatagtgggagtaaagattagagaaggaggtaaaggaaagaattgattagtttttttttgggaagagtaggtagggttatttttttttgttgggtatttggtagaatgttggttgttttagaatttggtttaggttttgggataggtttgtttgatttgatattatttttgtgtttttatttgtaaagttttaatatgttttttgttttgttaaagatagtgtggatgtaagagtatttggttaagtgagagtagttgggtaagtgttattagggtggggttttggggtttaggttatggttagagttatagttttttgtggatgtgggttggtagttgttagggagtgggattaggattagagattgtttttagatggttaaggtgttttatttgataatgtttttttttgttgaggttattttttttttagggtataggtttatgtatagggtttggattttatttgggatgggagtggtttatgagggagggtttttatggggatttagttttttagggagtagagaggttgattatgtaggattttgagtagtttgtttttggattttaggtttttaggaggagggtatatgtagtttgattaaggagaggttggagggtggtttattggggatagtgttttgtttatatatgagggtttggattttatttttaattttaggtttgtgaattttttatagttgtggtttttttttagattttatggagagtatgttattttatgggaaaggagttgttttttttttttattttttttagggtatgttggggttttattagtagttgtgtattgatattataggttgtgttaatatgtggggtgagtattgggataattttatttgtatggtaagggtatataagagggtagtggtttggggggtggagagtttgtttagtttttgtttttagttttttttttttttaatatttggtttttagatttttaaattttattaggttgaaatgtgatgtttattgagtttgggatgggtatttgtgtttgaggtagtttttggggttttggttgaggtattttaggtaggaggggtttttataagtagtagaattttttatatttttttttaggagatgtagggttggggttatattgaggagggaagaggagatagtaggttgttgtttgggttaggatttaagatttggagtagggagtgtggagtggagggatagtagtagttttttagagttaggtttttgttttgtttttggtggggtttatttaggggtttatttaattgttttagtatttagtataaatggagtatttattgtgtgtgggtttttgtgtgggttgttgtagtgtggaggatatagggatgaataaggtaattagtaaggtatttttagtttagtttggagggatgaaatttgtatatgttattttattgttaagttgttaaatagaagatttttatgaattatttagtaaattgaatagattaattatagtagatatttgttttaaattgtgtgtgttttgtatgataaagaattgattatgttaatataaaaagggattttaagtaataggaagttggggaagagtattttaagtgggtaaggtttgaataaataattttaagaaagataaatatagatagatggttaataaatatattaaaatttgttattattattgataattaaagaaatgtaaaataaaagagttataaaatattggttttgatatattagtgaggtttaaaagttgttggtgaagatataggggaaagggtgttttgagtttttttttttatgtttgttagtagaggagtggatatagatattgggttatatttttaagggaattttgtatagtttgttatatgatgttgtaaattttttattagtaaaaattaattttatattgtttgttgggtgtagtggtttatgtttgtaattttagtatttagggaggttgaggtgggtggatgttttgagtttaggagtttgagagtagtttgggtaatatggtaaaattttttttttataaaaaatataaaaattagttgggtgtgatggtatatgtttttggttttagttatttaggaggttgaggtgggaggattatttgtgtttaggagttagaggttgtagttagttgagattatgttattgtattttagtttgagtgatggagtaagattttgttttaataataataataataataataattttatattgttaaaagaaaagattattaaaggtatgtgtagtatgttttttatttatatttgggtttttataaaagaagtgtagatatttgtatattgaaatgttaatagtaagttatgttgtagaggtaggattggaggtgattattatatttttatattttttaaaaataagatttattatttttgattagtagagaaaagtaataaagttttttttatttaaaagatagaaatttgattaaagggattattagaggttgaagagttttaggtttgttaggtgtagtggtttatatttgtagatttaatattttaggaggttgaggtaggaagattgtttgaggttagtagtttgagattagtttgagtaatatagtaagattttgtgtttattaaaaaaaaaaaaaaaaaaaaaagtttttaggttgggagttttgtgtaggttgtttggttgggagggagagtggagatggtgggaagtgggagagaagatagagtggtatatagtgaggttgggattaaattgtggggtttttgggttggttggataagtggaggttttgtttagaggggatgtggttgtaattggtgataggagtgataaagggttggggtgtgtttgtaggtgggagatttgttgttggaagttattttagtgtatatggtagtggtgggttgttttattagttttttgaggattattttttatattattgattaggtttagaaggaattagttatgaggtgttttatgtttagtttgagtttttgttttttggtagtttttgaaattttttggtttttgggttgggttgtttatgttggtttgttattttttagttggtttagggttattggtgttatttataagaaggttttaggttagggtttttttgggggaaggtggttttaggggatgtggttattatttggatatttttgagggattttgtggggtagaagtggtgagtagttagtgtggtttgaggttagtattagttttggggtttttggtatagttgaattggaattagtatagtttgtttagggtaggtgggtgggttgttagggtatagggtagttttagagtttagtttatttggtgttgtttggggaaggtattagttttaggttttattaatttttgagtgaggttagattattgtggtatttttttttgtttgagtttttagttttagtttttttttttatttgtaaggtgtatgttggttgtggttgtattgagtttagtttgtttttttttaggtttggtatttaggtttttggaggagatatagttatttgaattttttgtttgaataattttagtttttgtggtaagatatgtatgagagaagttagtgtttttgttataggttgtgttttgtggtgagttaggttgggagggaaggtgggagggaagttgatggtttatgaataggatttaggtgtttagggggtttgtggttatggaagtgtggatgggtttatagatgttttgtttttattagggttgttgtttggaggaatagataataagaggggattttttttttatttttttagttggtaggatttgatttgtttgagagttgttggggatatagtggggataggatagtagggtttttgttgaggggttttttttttgatgggtgggatagatgtgattgtggattgtagtgtgtggagtgtgtggtatataattgaagggaaggttggagtgttgggggaatgtgttgaagggttaggtttttttgtggaggggaggtagagtgtaggttgagtttaagaggaagggtaagttgatgtgggttaggggagtatgtgggggtaaagagtgttttgggtttgagaaagggttaggagaggaagttggtgatattgaagagggggttttggttatgtttgtttttgaggagagttgtgagtaggattgaaggtaggaggggaggggaagatgggtttgatgtaggtagatgtttaggtttgggataggattttggggattttttagtttgggggtttttgggagatgaggtggggttattggttgggtgtgggaaggtagatggaggtgttagaggagggtagggatagtttgatattgttatggtgtaggttggagagagagtaatggggagttttagtttaggttggggatagattgatgggggtggtaatttgtttagttgggggattttttttagtggtatttagagggatggtatagtttagtttttttagggttaggtgttgttaggtgggtgtaaagggagatatgaggatgttggtaagatagaggtggatatggtggtttttaaagattagtttgtttggggaaggatgtgaaagttgatataggttgatggatagatggggagaaggaagggtatgtgggggttagagagtttagtttgtttataaataggttggaaggagaagtagttgtgggagagagtagagtatttgtatttaggtatttggatatggagatttggttttgtgattatgaggattttaggtgatagagttaaatggtataagtttgtaaagtttttttaaaattttaaatgagaattgtttggaagtggtattagagaggtagagaggtattttttttatttgggtatgggagaataggttatttttgtttgggggtatgaggaggagggggttttggggggttgtttgttttttttttattttttattttgttttatatatttgttttagatatttgtttggattgggagatttatgttttagaagataaggaagattggttggtggagttgttggtgttttatgggttattttttttgttgtgggattaagttgggaatgagtttgtgtgttttgatatttttgagggtggttgttttttttggtttttaggtttttttagtttattggaatttagttatgaaattgatttattagtgagtaggggtggaggggtggggtaggttggttattgagggttattgaggtgtggttagtaggttagttgaattttagtgattgtgtgaattttagtgattttttggtgataggttgagggtagttttagtgttagtaatagggtggtatagaagtttattttagttattttgtaggtatatgagggggtgttttttggttatttgtattgtattagttttaagtaggtggtgagttggggtatgggttgggagttgtttgtattggttggttagtgggtatgggatagtgttaaggttgttgtgtttatgttaggtggtttttgttgggggtagtagtattatttatattttttttatttttatggtgtttagttttgagattttgtataaggtggagtgtattggttatgttttgggttttatgagtttggatagtaaggtgagtttttttggtttggggtgggggttgtagttattgtttttttttgggtagtatgttgtttatttagtttagggattagttgtgattagatttgggtttagtaggtggaaagggagattttagggaagaggtattgtttgtaggattttgtggtgggatttttgaaattggatttgtatagttatgtgaggtttgtatagtgagttagttggggtgttttatttttttttatttttatggggtgtatttttattaggtattggtggagttaggtagggtttttagagtaaaaggatgggtatgggtggagaagttagtagaggagtttagggaaaggttggtttgaggttggatgagtagagtgggggtagttagaaggttttaggtgtttggtttgttttaataatgtttattgttgggtaggttaagtgtggagttggattatggtggtagtatggaattttagtgttaggttagtgattttatttttgagtagttttgttttggggtgagtgtgttgttattttttggttttgttagtttatttggattttagatgtttttgtgtgtttttgtgggatttaggttttatagtttgagtttaaatttttttttttagtttttttagttttattttagagttatggggttgaagagagagataagatgtattttttgttttttatttttgtggttgtttaggtgttgagtgagttggtgattatttattatttgaagttgattaatattatagagattttatattatttttggtttatggtttttaggtttttttttgttttttaagatggggtgagttaggattatagagtttttggttttggttagaagtaggagtgtgaggaggagatagttttagtggataagtagttggtgttttaagtataggagaatatgttggttagtgggggagtttgtagtttttgttttgatggtatatttttatatgtgtatagatagtatttttgtatgttatttttaggtgtttgtatttagatgtaaattgtatgtttgattttgttatattttgtatgaatatttgggggtgtatttttattagagatattatatttagtatttttgtataagtggtttatatgggtatggttatattagatgttgtgtttatatatatgtatgtatgtgttttataaatgtttttagattttttttttttttttagtttttattgttgagatgttggtggaggttgatgtatttttgtgagtattttttttttttatatatatagattttgtttttttgtgtaagtttagggtttgtgttttagtttaggtgagtttatggggttgttataattgtaagatattttaggttttaatgtaaaatttttttttttgatttatttttagtgataattggattttggatttttagagttggttaggtaggggaaggttttgggaatgttaggattttattggaaattattaattttttttggtttttgaggtaattggaatgaggttgagtgtgtgtatatttatatttgtatagtgggtttttagggtgtgtagaggtaggttgagggtagatagtgttgttttgttttttatttttttttttgttttagaggtttttttttttttttttggagggtttttttttatgttgtgtttttttgagttttgttaggttttagttttattttgtatatttttgggttgttttatttatttttagagttttagtgaatagttatattatttttatttaatgtatattttattgtgtagtgagggtttgttgtgtattagatgttgtgttaggtgatggtattttttgaggattttattatggaggttagggatatatatggatttgtagaagatagaatggtatttttgatttattttgtgtttgttttttttaatgagttaaatggatgggaaggtttagagtatagttagaggttttattttattagagtttttaaggagatatggtggttagttattaggtatttaaaagtttttggtagttttggggaagtttaaaagttttagaaaaaggatattatataattaatggtgttgtattttattttttatgtgttaataatgtttaggtttttggtttttggttagaattattttttaggttttagagttaaatttaatttgtttaaagtgaattttttattttttttttattttgttttgttttatatttgtgttttttttttgtggtggtattttgttttagtaaatattaattttagtttttttgtttatgtttagagttttggtattttttgttttagatttatttttgattaagttattaagttttgtggatgtttttttttaaagtttttttaatattatttttttttttttatttttatatttatattttggtttaggatagtagtttttaagtttggtaatagattagtggtttttttttttttagattgggttttgttgtgttatttaggttggagtgtagtggtgtgattatggtttattgaagttttgattgtttggggggtttaagtaatttttttattttggttttttaagtagttgggattataggtgtatgttattatgtttagttattatttgtagagataaggttttattatattgtttaggttggttttgaatttttgggtttaagtgatttttttaatttagttttttaaagtgttgggattatagatgtaagttattgtttttagtaaattagtatttttgataaagtttgttaaggtagtagtttttagattttatttttagatatgtgaaggtttgggtgaggtgtaagaatttatatttttaataagtgttttattgttgattttgagaagtttgtattaaggatttgtgttgggagttaggagtttaagttttattttgtttagttttagttatagttttagtttttggtttggtattattatatttatgtgtggtttgtagtttatttttttattaggttagtgatttgttagaggttttttattatttttagtatatagattaagttttttttttgtttttgagtttaattatagttttgggtatttgaagttgtaaagggtaatttgtttatgtttttttttttttagtttttgatttttgagggtagatatgatttgtttttgatattagtagggtgttgggtagagtaggtgttgggtagtgtttgtggaatgaaagtattaggttggggagttgttgggttgttggttgggtaaggttgggtttgggaggaaaggaggatggagttttaggtggggaagtggttatttgttttttgtagttggagttgatattatgtttatatttgtttaggtgaatgtgttttttttattttttttggagttgtttttttattagaagtttttagttgattagatattgtttggggtggatatttagtagagtgtgagtggagagagagagatggtgtttatttagaatttgtttttggagtatattaattagattatttaggtatgttttaggtttatttatatgtggaggagggtggaagtgggttgggttgtgttttgttggggttagaggaggaaagatttagtagggtttttagaaataaggagtttttgtttttgttttggggtttagttttttttagaagaggttttgtgtgtagagagatgagggttatttaattttatttgttttatgagtttaaaattaggtgaggggttagagtgtgggaaattagggaaggttttttgtgggaggaaggatatgaagtttgaatattatttaattaaggaagggaaatatgttgatagttaggttaaaagaaaggtttgatgggtgggatagagtatttgaagtagttgtgaaggatagttttggggtttgttaggttttaagtattagggtgagtattatggattaggttattaggttgtagtgtggaggttaagtaggggttgttagtaaggagtgtgaaggagtggtttggggaagattttagagaggttgggggtaggaggttgagtagtggagttgaggtgttttagtttggtatttgggtagttgttggggttgaggttgtgggatggtgtatggtagtgtttgagtgtgatgtaggggttgttaggagatagaggagggtataggtggggtttgtggttaaggaatatagataaatggtttatggttgagaggagttgagggttgggttttgggggttattataggaggagtagtgaaggagggtagagtttaattagttagggtgtagggattgaagttttatgagttagggaggtagggatagtgggggaatggatggtattattttggttttttttttgtgtagatttttagtagtagtttgtggttttttaaggtggtgttggttttttgttaatttttgggagttttttgttttttttaggagtattagtatttggggttagtagggttttgtgtgttttagaggttttggtttagagtttatttagaatggataaggttgtttggttttttataggtggtgtttttgtgggttgtggtggttgtgtttgagttgtagttttttattagttgggtggattttgggatttgttttgtgagttagtagtgagtttgggaggtttatttgatgaatttgagtgggtgttgaagttattggattatgttgatgggtatgttttattttgttatttatttattgtttttttatagggttgtgttaagagaagattttttaggaaggggtttttgtgtgttgtttttgtatgttggtttttagggtaggtattatttggaatttttgtagagtagttagttttttaattttatatgattttagggttgttttgttttgtagtgttgagtaagattagaggtataggtttgggggtgggtaaagtttttttgtgggagtatatggggttgtttgtatttatgtgtttttttttttttttggtgtaggttagtaggagttagttaaggttgttgtggtttttagggtttttttaaatagtgggttgttagaagtatgatttgttaatgtatttttaatttttattgttttgtaggttttttttattgttaggtgtagttttttttaattttttttaaattgtttatagagtttggattttttgtttaggtgttttttaattttagtttttatatgttttttataggagtagtgagttgtatgagtttatgatggtggtggaaggtgtgtttggtgagaagttttgtattttgtggttttggggttaaggtttttatgatgagagatatatgttgttttattagttttgaggttttgttttagtttttagttttaggttttagttggagaaaaaatattgtttagggattaggagtagttttttagtataaagatatagatttggggatttggggatttttgggtagtttttggaatggaagaatttttttttataatggttttagtttaggtttttatgatatgtttttagagttaatataaaggataggttatattatagtagagattattatattgagattattatttagtgtatagtgaagattagtatggtaaaattagttttggaaaaaaattatagttattaagataaatttatgtatttttattatgtttattgtattttttatttatggatttgttttgttttaagaattaattatggttttgtggtttgggtgatttaggttgtttttattttgtatagttaaagagggtttgatgggtggtttaatattttatttatttttatattatgttattagtgtttatattttttaaatgagttgaagtgttttgatttgtttattgtta

SEQ ID NO: 237 - DNA, 85734 bp, Artificial Sequence
  Chemically-Treated DNA
tggtagtggatagattaaggtattttaatttatttggaaaatgtgaatattgatgatatggtataggagtgggtggggtgttgagttatttattagattttttttagttgtgtaagataaaagtagtttgggttatttaggttataaggttatggttaatttttaaggtaaggtaaatttatggatgagaagtgtaatgggtatagtaaaagtgtatgaatttattttagtggttgtggtttttttttaagattaattttgttatattggtttttgttatgtattgagtagtgattttaatgtggtggtttttgttgtggtgtggtttgttttttatgttagttttgaggatatattatgagggtttaggttgagattattgtggaagggggtttttttattttaggagttgtttagaggtttttaggtttttaagtttgtgtttttgtgttgaagagttgtttttaatttttgggtaatgttttttttttagttggggtttggggttgagggttggggtggagttttagggttggtgaggtaatatgtattttttattataggagttttggttttggagttgtagggtgtaggattttttattgagtatattttttattattattgtggatttgtatagtttattatttttgtggggagtatgtgggggttgaggttaggaggtatttgggtagggggtttaggttttgtgggtagtttggggaaggttggaaggggttgtatttggtagtgaagaaaatttgtaaggtgatggaggttgggggtgtattggtggattgtgtttttagtagtttattgtttggggagattttgaaggttatagtggttttggttggtttttgttggtttgtattaaagggaagggaagatatatgagtgtaggtagttttatgtatttttataggaagattttatttatttttgggtttgtatttttggttttgtttagtattgtagggtagggtaattttgagattatgtgggattgggggattggttgttttgtagaaattttaagtggtgtttgttttgggagttagtatgtagggatggtgtataggggtttttttttggggggtttttttttggtatagttttgtaggggaatggtgggtaggtggtagggtaggatatatttattagtatagtttagtagttttggtatttgtttaggtttattaggtagattttttggatttgttgttggtttataaagtaggttttaaagtttatttagttggtggagagttgtagtttaggtatggttattatagtttgtaggggtattatttgtgggagattaggtaattttgtttattttgggtgggttttgagttagggtttttgggatatatagaattttgttgattttaagtgttgatgtttttgaagaaaatgggaagtttttagaagttggtaggggattagtgttattttaaaaggttataggttgttattgggagtttgtatagggaaagggttagggtgatgttatttatttttttgttgtttttgtttttttaatttataaagttttagtttttgtattttggttggttgggttttgtttttttttattgttttttttgtggtggtttttaaggtttagtttttagttttttttagttgtggattatttgtttgtgttttttggttgtaggttttatttgtgtttttttttattttttggtagtttttgtattatatttaggtattgttatgtattattttatagttttagttttagtagttgtttaggtgttaggttagagtgttttggttttattgtttagttttttgtttttggtttttttagagttttttttaggttatttttttatattttttattagtagtttttgtttagtttttatattatggtttggtgatttggtttatggtgtttgttttggtgtttgaagtttggtaagttttagggttgttttttgtagttgttttaggtgttttgttttatttattaggttttttttttggtttggttgttaatgtgttttttttttttgattaaatggtgtttaggttttatgtttttttttttgtagggagttttttttgattttttatattttggttttttatttggttttgagtttatgaggtaggtgaggttggatggtttttatttttttgtatatagggttttttttaggggagattgagttttaggataggggtaggggttttttatttttgagggttttgttaggtttttttttttttggttttagtagaatatagtttagtttatttttatttttttttatatgtaggtgggtttggggtgtgtttgagtggtttggttggtgtattttaggagtaggttttgagtaaatattatttttttttttttatttgtattttgttgaatgtttattttaggtagtgtttggttagttgggagtttttgataggagagtagttttagggagagtgagaaggatatgtttatttgagtagatgtggatatggtgttaattttggttgtagagggtaggtggttatttttttatttggagttttatttttttttttttttaggtttagttttgtttagttaatagtttagtagttttttaatttggtgtttttattttataagtgttgtttagtatttattttgtttagtattttgttagtgttagggataagttatgtttgtttttagaggttagaggttagaagggaagggatatgagtaagttgttttttatagttttaaatgtttagggttgtggttgggtttagaggtagaggaaggatttggtttgtgtgttgaggatagtgaggagtttttgataggttattgatttggtggggaggtgggttgtagattatatatgagtgtgatgatgttagattaggggttgaggttgtaattgaggttggataggatgaagtttggatttttggtttttagtataggtttttggtataagttttttagaattaatggtgaggtatttgttaaaaatataaatttttgtgttttatttagatttttatatgtttggaggtggggtttgggagttgttgttttaataagttttgttaagggtattaatttgttgggagtagtggtttatatttgtaattttagtattttgggaggttgagttgggaggattgtttgagtttaggagtttaagattagtttgggtaatataatgagattttatttttgtaaataatagttgggtatggtggtatgtatttgtggttttagttatttgggaggttgaggtgggagaattgtttgaattttttaggtagttgaggttttagtgaattatgattatgttattgtattttggtttaggtgatatagtaagatttaatttaaaaaaaaaaaggttattgatttattgttaggtttagaaattgttgttttaaattaagatatgggtgtagggatgaagaaaagagaatagtgttgggagaattttaggagggggtatttgtagggtttggtggtttggttagagatgggtttaggataaggggtgttagagttttgggtatgagtaagggggttggggttggtatttgttgagataaaatgttattataaaaaggaggtatagatgtggggtaggataaggtggggaggggatggggagtttattttggatagattgagtttggttttagagtttgggagataattttggttaggagttagaagtttgagtattgttagtgtatggagggtgagatgtagtattattaattatgtgatgttttttttttggaatttttgggtttttttagagttgttaaggatttttaaatgtttggtggttaattgttgtgtttttttggaagttttggtggaatggaatttttggttgtgttttgggtttttttatttatttagtttgttgaagggagtaaatgtaaagtgggttaagggtgttattttgttttttgtagatttgtgtgtgtttttgatttttatgatgaggtttttggggagtattattatttagtatagtatttagtatatagtaggtttttgttatatagtggagtatatattggatagaaataatatggttgtttattgaggttttggaaatggatgagataatttagaaatgtgtagagtgaggttaggatttggtagagtttaagggagtatagtataaagggaagttttttgagaagaagaaagagggtttttgaagtaggaggggaagtaggagatagggtggtgttgtttatttttagtttgtttttgtatattttggaagtttattgtgtagatatgggtgtgtgtatatttagttttattttagttgttttagagattagaggaagttgatggtttttagtgaggttttgatatttttaagatttttttttatttaattaattttgaaaatttaggatttaattgttattgagaataagttagaagaggaaattttatgttagaatttggagtgttttataattatggtaattttatgggtttatttgagttgggatataaattttgagtttgtataggaggatggagtttgtgtgtgtgggaaggggaggtgtttataggaatgtattagtttttattagtattttagtagtggggattaagagggaaagggaagtttggggatatttatggagtatgtgtatgtatgtatgtgaatataatgtttggtgtggttatgtttatgtgagttatttgtgtagaggtgttgaatgtggtgtttttggtgggagtgtatttttgagtgtttatgtagggtatggtagggttaggtatgtagtttgtgtttgggtataagtatttgagggtggtgtgtaggggtgttgtttgtatatatgtgagggtgtgttattgaggtaagggttgtagatttttttattgattagtatgtttttttgtgtttggagtattagttgtttgtttgttgaggttgttttttttttatatttttgtttttggttagggttaggagttttgtggttttggtttgttttattttgagaaatggagaagggtttggagattataagttggaagtagtgtgggatttttgtagtgttggttagttttaggtggtgggtggttattagtttatttagtatttgggtagttatagaggtaggaggtagggaatgtattttgtttttttttttaattttatggttttagggtagggttgggagggttgggggaggggatttgggtttagattataaggtttgagttttataagggtatatagagatatttgaggtttaggtaagttggtagggttagagggtggtagtatatttattttagagtagggttgtttgggaatgaggttattggtttggtattggaattttatattgttgttgtagtttagttttatatttagtttgtttagtaataggtattgttggggtaagttgggtgtttggggttttttggttgtttttattttgtttatttagttttgggttagtttttttttgggtttttttgttgatttttttatttatgtttgtttttttgttttgagaattttgtttggttttattagtgtttggtgagggtgtattttatggggatgaaaggagatggggtattttagttgatttattgtgtaggttttatgtagttatgtaggtttagttttaggggttttattgtaaagttttgtaggtgatgttttttttttggaatttttttttttatttattgagtttaagtttgattatagttgatttttgggttgagtaggtagtatgttatttaggagggagtagtggttgtggtttttattttaggttggaagagtttattttgttgtttaagtttatgaaatttagggtgtagttagtatattttattttgtgtaggattttagggttgagtattataggggtgaaggagatgtagatggtattgttgtttttagtagggattatttggtatagatatagtagttttagtattgttttatgtttattggttggttaatgtagatagtttttagtttatattttaatttattatttgtttggggttgatatagtataggtggttggagggtatttttttatgtgtttgtaggatgattgagatgagtttttgtgttattttattgttggtattggagttgtttttaatttgttattaaggaattattgaggtttatgtagttattgaggtttaattagtttattggttatattttagtggtttttagtggttagtttgttttgtttttttatttttgtttattgatgagttagttttatggttgaattttgatgaattggaggggtttggggattagaggaggtagttatttttaggggtattagggtatataagtttatttttggtttggttttgtagtgggaaaggtggtttataaaatattagtagttttattagttggttttttttgttttttggaatataggttttttaatttaggtggatgtttggggtagatgtgtggagtagggtgaggaataagggaggagtagataattttttggggtttttttttttttatatttttagatagagatgatttatttttttatatttaggtggagggggtgtttttttgtttttttaatgttatttttaggtaatttttatttaaaattttaaaaaggttttataggtttatgttgtttggttttattatttgaagtttttatggttataagattaggtttttatgtttagatgtttgaatgtaggtgttttgtttttttttatagttgtttttttttttggtttgtttgtgggtaggttgggttttttaatttttatatgtttttttttttttttatttatttattagtttatgttagtttttatgtttttttttaggtagattagtttttgggggttgttatgtttatttttgttttgttagtatttttgtatttttttttgtatttatttggtaatatttaattttgaaagaattgaattgtgttgtttttttgagtattattgggggaagttttttagttgaatagattgttatttttattaatttgtttttaatttaagttggggttttttattgttttttttttagtttgtattatgataatgttaagttgtttttgtttttttttgatatttttatttgtttttttatatttagttggtagttttattttattttttagaagtttttaagttgagaagtttttaaagttttgttttaaatttagatatttgtttgtattgaatttatttttttttttttttttgtttttagttttgtttgtagttttttttaggggtaggtatggttagggttttttttttagtgttattagtttttttttttaatttttttttaggtttagagtattttttgtttttatatgtttttttggtttatattggtttatttttttttttagatttagtttatattttgttttttttttataggggagtttggttttttaatatgtttttttagtattttggttttttttttagttgtatgttatatattttatatattgtagtttatagttatatttgttttatttattaggagggaagttttttggtagaaattttgttgttttgtttttgttgtatttttagtagtttttaggtaggttaggttttgttggttggaggaatgagaaagggatttttttttattgtttgtttttttaaatagtaattttgatgagagtagggtatttgtgggtttatttatatttttgtaattataggttttttggatatttgggttttgtttatgggttattggttttttttttatttttttttttagtttggtttattataaggtatagtttgtggtaagaatattgattttttttatgtatgttttattataggggttggagttatttaggtgaagggtttgggtaattgtgttttttttggagatttgggtgttgaatttggagggggatagattggatttagtatagttatagttagtgtatattttgtaggtagggaggagggttgggattgggggtttaggtagggggaaatattatagtggtttggttttatttgagaattaatgagatttggggttggtgttttttttaggtggtattaggtgagttgggttttggggttgttttgtgttttggtaatttatttatttgttttgagtagattatgttgattttagtttaattgtgttaggggttttagggttggtgttgattttggattatattgattatttgttatttttgttttataaaattttttagagatgtttaggtggtggttatgttttttgaggttatttttttttagggaaattttggtttggaatttttttgtaggtggtattaatggttttaggttagttggagaataataagttaatgtgggtagtttagtttggaggttggagggttttaggggttattagggagtagaggtttaggttgagtatggagtattttatggttggttttttttgggtttggttaatagtgtaggaggtggtttttagggagttgatggggtagtttattgttgttatgtgtattgggatgatttttggtagtaggttttttatttgtaaatatattttagttttttgttatttttgttattggttgtgattatattttttttgggtaaggtttttatttgtttagttagtttaggggttttatagtttggttttagttttattgtgtattattttgtttttttttttattttttgttatttttatttttttttttagttaggtagtttgtataaagtttttagtttgaggatttttttttttttttttttttttagtagatatagggttttattatgttgtttaggttggttttaaattattggttttaagtaatttttttgttttagttttttaaagtgttggatttataagtgtgagttattgtatttggtaagtttgaggttttttggtttttggtagtttttttgattaaatttttgttttttaaatgaaaagaattttattatttttttttgttaattaaaagtaataaattttatttttagaaaatataagagtgtgataattatttttaattttatttttgtagtatgatttattgttagtattttagtgtataagtgtttatattttttttgtgaagatttagatataaatggggagtatgttgtatatgtttttaataatttttttttttaataatataggattattattattattattattattgagatagagttttgttttattgtttaggttggagtgtagtggtatgattttggttgattgtaatttttaatttttgggtataagtgatttttttattttagttttttgaatagttgggattagagatatatgttattatgtttagttaatttttgtattttttgtagagaaggggttttgttatgttgtttaggttgtttttaaatttttgagtttaagatatttatttattttagtttttttaagtgttgggattataggtatgaattattgtatttagtgaataatataggattaatttttattaataaagagtttatagtattatataataggttgtgtagaatttttttagggatgtggtttaatgtttgtatttatttttttattgatagatgtggagaagggggtttaaagtatttttttttttgtatttttattaataatttttaaattttgttaatgtgttaaaattagtattttgtggtttttttattttgtatttttttaattattagtggtggtgatagattttaatatgtttattggttgtttgtttgtatttgttttttttggagttgtttatttaaattttgtttatttgggatatttttttttagttttttgttatttaagatttttttttatattaatatgattaattttttgttatatagaatatatataatttaaagtaaatatttattataattaatttgtttaatttattaaatagtttatgaaaattttttatttaataatttaatggtaggataatgtatgtaggttttatttttttagattaaattaggggtgttttgttggttattttatttatttttgtattttttatattatagtggtttatataggaatttatatatagtagatattttatttatgttgagtgttggagtaattaaatggatttttgggtgagttttattaagggtggggtaaggatttggttttgggaggttgttattgtttttttattttatattttttattttaagttttgggttttggtttaggtagtagtttattgtttttttttttttttttgatatggttttagttttgtattttttgggaaaaggtgtggaaagttttattgtttatgaggattttttttgtttgaaatgttttagttagaattttagaggttgttttagatatgaatgtttattttaagtttggtgggtattgtgttttaatttggtgaggtttgagagtttgagggttaggtgttggaggggagagaggttgaaggtgagggttgggtagattttttattttttaggttattgtttttttgtgtatttttattgtgtagatgaggttgttttagtatttgttttatatgttggtatagtttgtgatgttaatgtatagttgttggtagggttttagtatgttttgggaaaagtgagggaagaaagtagttttttttttgtgggatagtatgttttttataaaatttgggaaagaattgtgattgtgggggatttatgggtttggggttgggagtgaggtttaaatttttgtgtgtgagtaaagtattgtttttgataagttattttttagtttttttttggttaggttatatgtgttttttttttgggagtttggaatttagaggtaagttatttagggttttgtgtggttagtttttttattttttgagaggttgggtttttatgggagtttttttttatgagttatttttattttaaatggagtttaggttttgtgtatgagtttgtgttttagaagggaagtggttttaataggaagaggtattgttaggtggagtgttttggttatttgagagtagtttttggttttggttttgttttttggtagttgttagtttatatttatagaaggttgtggttttggttgtggtttgggttttgaagttttattttggtggtgtttatttagttgtttttgtttggttaggtgtttttgtatttgtattgtttttagtagggtaggaggtatgttgggattttataagtggagatatagaaatagtattaagttagataagtttgttttaagatttgagttaggttttagagtaattagtattttattaggtgtttagtagaggaaggtggttttgtttgttttttttaggggagagttggttagtttttttttttatttttttttttggtttttgtttttattgtatttttattatttaaatatttttagttgtgggttatttgttagttgtagggattatttttttagaaatttaggtgggttttgaagtaggattttttgtttataggttttgtgttatggttatttttggatataaatttagtttagattttttatttttagtttagaattttgtaataggtttatttttagttttttttgttgatatttgtttagtattgggtatatattagttttttataatagaaagttaatgttttataaattgtttatgggttgttttttatttatagttgtggtttttaagttgggtttttttgttttattagattaggtggtgaggtgtttatatagtggagattttagaaaaaaaaagttttaaattataatgtttgattttaagttagagatttgtaaaatttttgaatatttaataattagtttttttgaattagtgttagttggttttggtatatttatgtgtatgtgtgtatgtgggtgtgtgtgtatatgagtatgtatgtatgtgtatatgtatgtatgtttatgtatatgtgtgtgtgtatgtgtatatgtgtatatatatgtgtatgtgtgtatatttgtgtttatgtatgtgtatgtatatgtgtatatgtatgtgtgtatgtgtgtatgtatgtgtatatgtatgtgtgtatgtatgtgtgtgtatatgtatgtgtgtgtgtgtgtgtgtgtttgtgtaagtagtattttagattttgtttttgtttttatatatagtagttttgttgattattgtttgatttatggggtattttattttattttttatatgttagtttaggtatgttattagtggtttttgaagattttttatttttgaattattttttttattttttggtttgtatagttttttttgtttatagtaattttttttttattataggtttatttgtttggtttattagaagtttttattttagtaggttaggttgaggaaaaggggttgtaattttagttttttttatatgtttatttagggtttgggaggtggatagtaggagttattttttttttgtttgtttttatgtttatttgtaaaaatatatatttttattttttatattgattagttattggttatttaagttatatagaggtttaatagggtatattttatttagttttatttgttttgggaagtgaaagaagtaagatttataggttggtttttttgtttaggttgttttgggggtttttgaaatatttaaatttgagggagaaatgggtttgtattggggagtgattggtgagaatgagttggtgagttatatgggtttttagtggtattgttgagttaaagtttaggtggagtttttttgggtggtttggttattgttttgtgttgaaaatattgttttgtgtttattggtattatgtaatatattatttttggttttgtttagggagttattttgggtgggtatgtagaagttgtttagatattaggttttatttttagatttttgttttattgagttgttaattatagatttattttttttgtttatttatgatgttgagagaggttttaaattttgtataaattgtttttggttagtggtatgttggtatggtttttagttgttgggttttatgtgggtaagtttagggtatttatagttttgttttttgttattttttgtttgttagggtattatgtttttaagtgtgtgtggggagattatatagagggtagggatggggtaaagggagttgtttttataggagtggtgagtggttgtaataatattgtggtgtttttttgtttgtaggaattagatgggtgtagattgatattatagtgttgtgttggttttgggtgtggttgttttattttttagtttattgttatttttagattattaattttgggtttatttgtaattagagttttttttagagatggtaatggttatttgtagtttttggggttttttagaaatgtttagaattagtggtttttttatgtttgatatgtgataagggagggttagatgggttagttttttttataagaaagtttatttaggggttagattaggtttggggtttttgaagatgagtttagatggttttttgtagtataggggattgttgtggagttttgatttttggttaggtttatttttagtttttttagtgagtttagttagttgatttgtttttagttttaggaagtttggttttttttttaggttttatggttgtttgagtttgttttaaatatttgggtatgtttatgtgaagggagattttttagagagggtttttggagaagttgtgtattttttttgatgaagttgttattttagaaattaaattttttttgagtaagatttgttttatatttgggtttgtttgtttgttgttttagagtttaggttggttatttttatatttgttagggggagttgagatttgagtttgtaagtttttgtaaggaggaagtttttttttttataagaattataaagggatagttaggaatggttttatgattgagtatattttattttggtggtttttagtgggaaatttaggtattagttagtttttttgggtagtatttggtatagtgtttgttgtgagtaatagttttgttttggatttttgggtaaattagaaagttgggtttatttgtggttatagagaatggtttggggagggtaaaaatttatgttaaaggttaggtatggttagtgggttttagggtatatttttaggtttattttaggttttttgattatgtgtttttagggagtagatttagtaggaatggggattttagatttaaatgtaagaaattttttttttatttataagaattagtaatgtggtttaagttagggtttttttggtggtataggtgtgtatggttggtagggtgtttttttggttatttaggttttatattgttttatttatttgggtatgagtagttaattttaatttgagttggtattttttatttgggtttagtaggttatgtttgggggagattgttattatgtagaattttgtttggtgtttgaggagttggtagatatatgagtgagtttgttgttatttattgggtttttagaatggattagtatttagagagtgtttagtattgttgtatgtaatgttggagattggtagattggggtttatagtaaaattgatagggttgggtgtttatttttggggataaattatgggttttttttttttttttttttaattttggatggattttattatttgttgggaggttatttggataaaagaaattgtttttgaaggttttgagggatggggagtagagggtagatgtttttggtgtatatggatgtggttttatgttttatgatatttagagttttttagttagttatgggtaggagtagtattataattgggttttaatagttatttgggttagttatgggttatgttggttgggaggttttagttatgtttattagaaatttttttttggttagggaattggaattttttagaggtagggtaagaaaaagttggattagatatgttgtttttttgaggagtttttatgtatattatgagtaagggataggttgtgggagggaggttgagtatttttgttttgtgaggatatttgggggataatgtttttttttatgtgggtttttgtggttgagggttgtagattgttgtttgatgttgtgggtttatttattttgttttagtggaattgggtaggtaggagtgtgttattgataagtgtgatggttgtttttgtgggtatatttaggtagagatttttaatttttatttggttgttttgtaggtatatatggggtttttgtattttagtatatataggaaggtagttggaatatgaggaaataaaaggtatattgattagaaaagaagaagtaaagttgtttttatttttagatgatatgtagtttatgtagaaaattttaaggtatttatatttttagaaattttagaattaatgagtgggtttggtaaagttttaggatataagattaatatataaaaatgaattatatttttatatattaataataaatatgtggaaattgaaatttaaaatatagtattatttataattgtttaaaaagtagaaattttgggtgtaagagaaattgttgtaagaatattttgggtttattttaaagtggtttattttattttttttttgggtgtattttagaatggttattttttttttttattttattttggttaaataagagagaattttttttttagtttttattatgagaatttattgagtttttaggatttttaaatttttaagttagtttatatttagttattaggaatttgttgaaattattatttaagtgtttttttgttttaggtaaattgatttgtatttttagtatttgtttatatttttagtttttggggtggttatttgttttgtaattttaattttttgatagatttaagaaaaattattgttttagtttgtttagtttttttttgttgtgagagtaggagtttgatgggtaagttttttatatgtttgaatggttgaaggtattttgtaggtatgattaatgtttataattagttaagtttaagtaaaggagattattttagataatttagatgggtttaatttaattagttgaaaggttttttttttttttttttttttttttgagatagagttttattttgttatttaggttggggtgtagtggtgtgattttggtttattgtaatttttgttttttgggtttaagaaattttattgttttagttttttgagtagttgggattataggtatgtgttattatgttaggtaagtttttgtatttttagtagagatgaggttttagtgtgttggttaggttggttttaaatttttgattttaggtgatttttttattttggttttttaaagtgttgggattataaaggtgagttattatgtttggttattaaaaggttttaaaagtagaaatgggtttatttagataaagaaattttatgtgtttataatatttttattttgtttttaaaaatgttagtatgttttttttgaaaatttgttttatagattttaggtttgtttagttagtttttatagttgtgtaatttgattttttgtaataaatgttttaataggttattaagaaataaatattaagttttgattgatataattatattaagataaatttatatgtaaatataaagatagaataaatgtatttttgtttatttttttatttgatttaaagggtaattatataaattaataattgtaaaattgttttgataaatttataatgtataaatatgtaatttgtatgataataatagtataaaggaaggggagagaatagagttgagttatattatagtaatattttagattattgaaattaagttggtgttaatttaaattagattgttttgaaattaagatatattataaagttttggataattagtaagaaaataattttttaaaaagtaaaagaaatatggaaattaaaatggtatattagaaattatttatttaataaagaagaaggtaataatggaggaatgtaggaaatataaggaatgtaggaaatataaaatatatatagaaaataaatagtaaaatgggagatgaagttttattttattagtatttatattaaatataaagggattaaataatttaattaaaaggtagagattagtaaaatggattttaaaaaaatgatttaagtatatgttgtttataagagatattttagatttaaagatataaatagttttaaagaaaaaggatggaaaaatatatattatgtaaatagtatttaaaagagagttttaggagatatatgaatgttagataaaataggttttaagataaaaatggttattagagataatgaaggatattttataattataaaaagataaattagaaagatataataattataaatatgtatgtatttaataatagtattataaaatatatgaagtaaaaattgatagaattgaaggagagattagtaatttaataataatggttggagattttaatagtttatttttaataatggaaaaataattaattagaagataaatattgaaatagaagatttaaatagtattataaattaaatagaataggtaatattttatataataatagtagaatatattattttttttgagtgtataaggaatattttttagaatagtttataaaataagttttaataagttttaaatgattataattatataaagtgggttttttaataataatagaattaaattagaaattaataatagaaagaaatttgtgaaataaaatatgtgtaaattaaataatatatttataaataagttaaataagaaattataagaaaaattagaaaatatttttatattaatgaaaatgaaaatatgatatatgaaaagttataggatgtaattaagggagtggttagaggaaaatttatatttgtaaatataattttttttaaataaataaaaaagaaagattgtaaattaaaaattttagtttttattttaagaaattagaaagagaagagtaaattaaatttaaagtaagtggaaggatagaaataataaagattagaaagtagagataaatgaaatagaaaatagaaaaatattatagaaaattaataaaagtaaaagttggttttttgaaaatattattaatattgataaatttttagttagattagattgattaagaaaaatttgttgaagatttaaattagagaaattaggaatgaaagtggggatattattattgattatatagaaataaaaataattattagagaatattattaataattatgtattaataaattatattatagataaaatggataaatttttaaatttttagagtgatgtaaattattaaaattgagaaaaaaaaaaaaatttttttttggggggatggggtggggtatatagagttttgttttgttgtttaggttggagtgtagtggtataattttggtttattgtagtttttgttttttatgtttaagttatttttatgttttagttttttgagtagttgggattataggtgtgtattattatatttggttaatttttgtatttttagtagaaatggggttttattatgttggttagtttggttttgtatttttgattttaggtgatttgtttattttagttttttaaagtgttgggattatagttatgagttattgtgtttggttaagaaaaaagtttaaattgatttatataagaaatttagttataaatatattttatgttattatgttttgttttattgtattttatagatattgtgatttttataaattgaaggtttgtgataatgttgtattgagtaagtttattaatgttatttttttaattgtatgtttttattttatgtttttgtgttatgttttgtaaatttttttgttatagttgttatggtaatttgtgattagtgatttttgatgttattattgtaattgttttggggtgttataaatagtaattatatatgataatgggtttaattggtaaatgttgtgtgtattttgattgttttatttattggttatttttgtttttttttttttttttaggtttttttattttttgagatataataatattgaaattagattaattgataattttataatagtttttaagtttttaagtgaaaagaagagttgtatgtattttattttaaattaaaatgattaagttaaaaaatgattaagtttagtgaggaaggtatatttaaagttgatataggtagaaagttagttttgtgttaaatagataaattgtgaatgtaaagaaatgtaatatttagtaaatgttttatttgtgaaaattttgaagtaaaagataataaagtaaataaaatgttatgtaaataaggaaaagaaaataggagaaagaaataatgtgattaggttaattgataaaatagaggagaataaaattgttgtttgaaatttttgtataggttatgtgtaatgtaatttttaatgatggaatgagggtattaaagggtgggggagttgagtaaagtattgttgaagatttattggtttagttaggttagggttttagttttagagtttagagtaatatatggaagagtgggttgttttaggtatagaagttaaatattatatgattttatttaagtgggtgttaaaaatgtgtatatatggatatagagattggaatgatagataatggagatttggaagggtgagggtataggagggaaatgggtgatgagaaattagtttatgagtataatgtatgttatttgggtgatggatattttaaagttttgatttgattattatataatttatgtatataatataattgtatatgtattttataaatttgtataaataataaaaattaaaattgaaaattaagaaaaagattgggttgttatagtatttgtttttattgaagattgtgggtattatgttggagagaggttagggtagagtttgtagtaatattggattttttaattgttatgaggaggaaataattagaaagatgttatttttttatttttatttatgaatgaaggtatgaattgatttgtgtagttgtttagtatgggttttttttattgtttgtttagggttgttttttttaaaggtttttttttttgatggatttaggttagttgtgtgttttgagggtggtgatttatatgtattttattttttagaataggggtgttttttatatttatttttttttatttagaagaaatttataatattagttttttatgtaaattaatttttttttttatttaaaaataggattggataggtaaagattattagaagtagaagaaaatttaaaaagtaaagaagaattttaatatttgggaaaatagaaatttatttttttgggggaatttgagaggttgttgtattgataagattataatagattattatagaaaaggaaagatgtaagaataataaagtttgaaattttgaaatatgattgttttttttggagatagattttttttgttatttagtaggggaaggggtgggtatatgatttatataagagtaagagtaattagggtttatttttgtaaagagttagattggtttttagagattgttaaggtgggagtgtgtgagtttggagttttaagtggtttttttttaaggtagagtgtgaagggtttttgttaataggggagagaagggtttataaaaaaagagtagtagatgggttggggttgggatggaggtagagaagggggaaagagggtagagaaagagaggaagtagaagattagataaagggaaaagtgttgggtttttggatttagtaaggtgggaatgtttagttatgtgagttaatgtttttttttttttgtttaagttggtaatgtttgtgtttttattatttgttattgtaaatattttgataatataaggtttttttaggagaaagaatagagatagaaaaggaaaggaaataagtatagatttaatagaaagttttttttttgagttgtaggtagatttagtttttatatttaatgtttgtaaattgttttgaaggattaatgtaaagatttatatttagatttgtatttgttattataggaggggatatttgaataattgttagatggttaagtatataaagtttaataatatttgttatggtgaaagtgtggggtaatggttagttttatatattgtaggtagaagtataaaatgatatagtttttttggaggataatttaagagtatttatagagatttaaatgagtatttaaatgtttttataatgaaatattaaatatatgtaaaaatgagtataaaatatatatatagtttaaatatatatatagtttaatgaataataaaataatatttatgtattatttttatataattttagaaataaaatattattattagttagtttaagaaaatgaatatatatatatatttatttattgtaatttttgtttttaggatttaagtgatttttttgttttagttttttaagtagttgggattataggtgagtattattatatttggttaatttttgtatttttagtaaagatggggttttattatgttgttaggttgattttgaatttttgattttgtgatttgtttgttttggttttttaaagtgttgggattataggtgtgagttattatgtttagtaggaaaatgaatattttatttgaaaataatttgggaaggagtggggagaaggagataggggatatggatgaaatagtatttgtagtgagttgataattattgaagggaggaaagagtatgtggaggtttattatattattttttttgtttttatatatatgagaagttttttattagaaagaaagaaaaggagggaagtgggggagtggagggagaatgaagaagaaaaaaaggaatattattaatatttttgaaatttttagtatgttttttttagaatataatggtatgtgtttatttaaatatgttatattttttaaatgtttatttttttgttgatagatagtggttttttttagttttttttgtaggaatagtttagtttgagtattttaatatgagtatatattttttattgtgtatgtataaggatttttttgggagtatatttagaagggtaaatattagttgatgttaatgtagttttgaaagtagttatattaatttatatttttttaatatatatattttagaaagatatatatataatattattagtggattatttttagggaatggattatgtgttattttgagttttttttttgtaatttataaattttatagaatattaattttttggatttaatagttttaaatttagaatatttttagataaatatataatatagataaatatattatgaatatgtatagtttgttgtagtggttttttttatggtatttttatttttaggtattattttttatttttagttttaggatggtttttagatgttggtagtgtagggtttttaaggtgatgtttattttgtatttttttagagagtgaagttggttatttgaaggtttaatgttgaagggagatatttgttttggagaatatttaggaggatgagtattgaggatatttggaattgtagaggaattgggggttggttatgtttaattaaagttatttttaagttgttttagtttttttaagagttatttgggatttagaaataggtaagtaggtgggggattatagttataagagttttaggattaagagtatagaaattgagtttttaagtaaaggaatatataagttagagggttttatgttttggtttagatttgagagatagaaggtggagggaggtgttttagggaaaatggggagagttggggagttagaggagagttggtgagttaaattaggggggtagttttttgagtagttttaattgaggaaagttattaggttattagattaggggaggggagagtttattgtggttagattttttttttgtatttatgtggttttttttttattttttttttttgttttttattgtaggtttagttttatttatttgtttttatttttattttgtttttggtttgtttttttttttatgttaggtatatatataaagggagaggggaagggaaagagtaggaagaaaagtgtttttatttggggagggttttttatattttattttttttgttttgattgagagaggatatttgtttttgtaaggagttattttgttttattttgtttttgttgtttatgtgtattttttttggagttttgggggtggttgtagtttagggttgggttttagtagttttgtgttttttaatttgagattatttaataaattttaaattttaatattatttttgagagtttaaaagaatagagtgtagagaattgtagagagggaattattttataatattataatattggtaattatttttattataaaatatagttattttttatagtgggagaatattatagattgaaaattagataagagggattagatgtgatgttgttatttattagttgtatgattttggggaagttttgttttttttagttttttttttattaaatgaggaggttggttgaggtttgtaagtttttaattgtgttttggaaaattttaggaaatttttagaagtgtaggggattggaatgtggggagaagtaggatggggtagaggtgtttaataagggggtttttgggtggttggagtagttatagtttattttatgttttgggtttttgtataaagttttatttgaagaaagggtttttggttaaatataatgtggatattaaagatattgatgttattttgtttttagttttattttagtttaagtgttagttttagttttttgtggttttaggatttatggtgggagatggatgagttttgggagggaaagtattgaattttaagtttgtgtaataggtatttggtaatggtgttggtaatttgatgtatattgttataatttttaggttttagagtgtttagttataggttattaggtaaaggagtgaggtttttttggaatagaaaggaaagtttatttttttgtagaaagggaatgtatattagtaaaataaggtatatgtatggtttggattgttttttttgggttttttaatatagaaggaaaagtgtgtggtgttttgatttggagggtaagtgggtaagtaggatggggattttggtgggaagtagttagaaggagagtgtggttattagatatggttagggttttatatgtgtagtttattagggagttgtagttatgttgtggtgaaggggtggtgatgtatgatttattgtgggtattttgtgagtagttggtgatttgtgtgattttgttttgttttagattgtttattgtatttaaatatgattatgataatatttagttgtttttttttttatttttatagtgaaaagtgttatttgagttgaaataaattttgaattttttttttggagttttgggtttgggttgttagtttgtgattagatgttatttggtagtagatttttgggaggatttgaattttttagagagtggggaggaggtgggaatgtggttggagtagtagtagttttggaggttttttgtttaatttagttgtttatttttttttgttttagatggttttgagggagaaatttatgttttatttttaaatttgatggtagtgaaaggtataggaaatgttgatgggggattatatttggttgtagagaggagttgagttgttttagtgatggggagaataggaggtattgttaggttgaagttattaggtaggttttttttttattagttttgaagttttgatttaaatatattagggtaagttttattagggtaagttaaatgggtttattgtgggggtattagaggaattagtagtgtttgatttatatttttaggttttttttggagggagattgggtttttttttatgtgttatgtggttgggagttggttgatgttttggatttggatggagtttgtggttttttgttttaggtggagtagattaaattgaagggttgagatgttgatgatgagggtaggtttttgagatatttagagggtttgttattgggttatttggggatggtttagtgttttagttttgttatttttttgggtttattttattgtttagttttatttgtagtattttaaagatagttttaatgtgtaatattattggtgagggtgagtttttgattttatatagtaggttttggtttgtggggttagggatatttttagtaaagtttaatttaaaatttttgattttattgggttttgagaagagagggaaagggagaggtggagaggagaagtagaggtagtttttttttatgattgggtttagatatttggtttgtatagattttttattttttttatattttaggttttagttagagtagttataggatattaagagttttgtataagtttttttaattttgaagatttttttttgagttagttttaggtaggttataattttttttgtagtttttaaggtatttatgatttttgtgttgggttttattttaatgatgtggtagttgttgatttttttttataggtatttgatgggtgatttgttgttgttttatatttgaaagatatttgagattaggttgtttatttattgtttttttatgttaattttgtatttgttgaaggattgtaggattgtgggtttgtaaagagtttatatgatattttttggttaatttttggttatttaaagttatgggttttttaatttaaaagtattttttttttatattgtagtgtttgtggttgatatattttgttaaggatgggaataggttttatagttttaatttttagaggattttgggaggttgataaaagaagatagttatgtttggtttatgtatttgtgtaagttaagttgggtttaaagttttgggaatggttttagtttttatgtagtggttgttattatttgttttttttgttatattttttttatatttgtatttatgttaatattgttttggttagtttaggtaggggagagataatgatttattttaaaagttttttttatatttattttaatgtagtttttttttgggatgatgagggtatatggttttaagagaatttggaaaggttttattgagttttttattttgatttttaggataattatattatttatagagtaggaggagtgttttaggttttttgtttttgaattaaatataaatttattgttagttaggagttggtatatttggaagtatattttagagtgtttttgtttttgttttatgtttggttttgtgaaaaaaaaaatattgtttaatttatagtttttgagttttttaaattaaaggtattagttagtgtttgaaaggtgataagtattgatggttgtgatagtggtttagtataaggattgggatggggtattgttttgttgtttttagggattatttgtagttttttagtttgggatttttgtattgggttgtttggagttttagtttgaaggtttatattatgggggtaaagttttttttttatatttattattattgagggttttttagtttggttttttaagagtaataatgggtttggggtatagttttaaagtttttggggtggttttatagtgagtttagtgagtttagtgtgtttagtttattgtagggttgggttgttagggtaaggtaaaaaaaatgtttttattttttaaagtttgtggggattaggttgtttatttttttttatttgatattttttttaggagaatttttaaggtgggggaaggtttagttgtttattttttatttagggtttagttttttttattttataggttttgggattttttttagtattatttggagtatattgtgaaaattttttagttgtaaggtaaatatagtgttttgaaaatattattgtgttttagtaggttgttttggagaaggttggggtatggtaggaattttttttttttttagtttagttattagaaggattttttgaaaatttagggttgtttttttgttgtttttttttttttttaggaaaagtgaagttgttgttagaatatgagttaggatttaggggtttgttttagttgggtttgggtgtaagaagtaaaggtttttttgatgttgataaagttttttaatgtgtttgaagtattatatttttttaggatagataatgaggtagttggatgttgggattagaggtaggattatttattttagttttaaatttattaataatggttttggagtattttttttatgtttagtttgaatttttttttagtttattgtggtttatagggtttttttttatgttggggttagtgttgtgttaatttggtttttgggtttttgtattttattttttttaggggatgttgtggtatgggtggggatggtaatgttttttgttatagtagatatgtgggagatatttagagtggaggaagttagttaagggttttgttgtagatggggtgagtttgggattaggattagataaaatgagttgttttattttgtatattaggtgtgtattttaatttaatttagttaagtgttggtttgggtaggatagtattttggtgggtttagttgtggttttagtgtgattgaggaatataggtggggggtttaaatatatgatttaattatgtgtggttattgagatgatattatttgaattttatgaggagaaaagtttaggatgaatttgtggtttgtgtgggggtttagaattttttttttgggtatgatggagaaggtagtttttttgttggggtagtatttgatgttgtttatgttgaaggtttttttaggtatgaggggttgtaggttgggttttatgatttgttagtagaaggttagttttatgtgtttgtgggggtaatgtatttaaggttatgttttagttttgttgggattaggtttttttattttatgtttttttgttttgttttaagagggagtaggaaaggatttaggaataggaagaaattaggttagtttttatatttttttaatggaggattttttaatggaggaggggtagtaagtgggtgagggagtttaagatagagattatgtaagagagttttttgttttttagttatggtagttggaggttggatttattatgatttaggggatatggtaagttaggaatttatgttttaattattaaagtggaagaggttatatattattttttaatattgggaagattttttgtagtgttttttattatatgagtttttaaggtttgttatattaattttatttttgttttttgttttttttgttatgggtttttaggagagttgtgtttagaaagatatgtgtttattggttgttaataggaatagtggtaattttatagtataggaggggtaggatttgtagttattttgggggagagatgatagagttttgtgtaatgtttggggtttttagggtagttttggttgggaggttttttgagatttgttttggttttatggtagtgtttagaggtgggttaggaaataaatggtaaggagaatgaaatttatagattatagtttgtttgtttttgggatttggatggttttttttatataggtatggtatgttttttttggaaagttggggttggttagggatggtttaggatgatttggggtagtattatttaatataattttttgaagggatggagattttatagatttgtattgtttaatatgatagttattagttatatgtggttggtgttattgaggaagtgagtttttaatttaatgttaattgatttaaatttaagtagttaagagtggttattggtttttatgatagattgggttaatttggattttttaattgaatttggatatttattttgtgtttagttttttttaggtttttggaaggattttttgttttattgggattgagggttaggtaagtaagaagaagggttgggtattggggtatatataggggttatttatgtagtatttttaataattagttgttttttagttgtggattgaaggtttttaggtttaaattgtatgaagtgttgggttgttaagtttgtgagttttttagggtttggttggttttttttattagaaatatagattagatttaaagtaattagttgtttaatttttgttaaagtagagtaagtgaagttagtgaaggtttattagggttgaaattaggttaaggttgttgtaggatttatgttgttatttatatgtagttggttttgattatgatttttgtaagtttatattggagggaaaagggggatatttgtttataggttaatgtttttatatttttgaagattaaaaggaggtgattttgagaatttagtatatagtagatatttaattaatgaggaagggagagaagaagggagaaaaggagggagggaaggaggaaaagagggaaggaaggagggagggaggaagagagggaggggtggttaggggtattttgttatgatttttaggatgttttttttaattttgtagaaatttagaggtggttttggttgtttatgtgtgagttattggtaattttttaaaggagattaaagtgagttttaaaatgaaataatgaaagattttattttaggtttttagttgttttttgttagaaggttttttggattgttttggaggttatattggtttggtttttaaagttagattagagtaatgggtttgaaatgagattttggtatttggaggttgtagtatttttaatgtgtgtttttgatatatataggaaataggtgggttgttgttaatgttattgtggttagtggtttttggagttggggtagtttttttagttttgtttttgggagtatatttaagtttatttatggttattagtttttttatttggtagttgttgtatatgatgatgaaggtttgttttgttttttttaggttttttggggaaaataagatttgggggagagaagggttgttttgttattttttattaaagggtttttattttttttgttttttatttttttttttttggatatatatttttttttttgttttttattttttgtttttttttttgttattttttattttatttttaaggttaagtgttttattttagttttattttagagaaaagtagggagtaagttaaaaggatatgaagataaagtttatagagattaaaatataaatggtttttaaatgaatgataatatatatttttatttataataagagaaatgttaatgaaaattatttagaagaatggttttttattatttatattggtaaagagtagaaggtgagttgttataaatgtaatgatttgttttttattttttttttaatttttttaatttttaattttggtaattattattttattttttgtttttatgagtttaattatttaaggtttaatatataggtgtaattatgtagtatttgtttttttgtgtttggttttatataatgttttttagatttatttatgttgttgtaaatgataggattttttttttttgtagggttgttattttattgtgtatatatattttattttttttattttttattaatagatatttagggtgattttatagtttgtttattgtgaatgatataatgaatataagagtgtggatattttttaaatggtattttttgagtttaggagttagaggatgtagtgagtaatgattatattattgtattttagttagattttatttgtatatatatttagtagtaggattgttgaattatatggtagttttatttttaattttttgaaggaattttatattattttttataatggttgtagtaatttatatttttattaatagtgggtaaggatttttttttttttatatttttgttaatatttattttttatttttttgataatagttattttaatgggtgttaggtgggagtttattgtggttttaatttgtatttttttgatgattaatgatgttgagaatgtttttatatatttattgattatttatatgtttttttttgaggaatgtttaattggtttttggtttattaaaaaaagtaggttgtttttttgttattgtattaagttttttatatatttttggagttaatttttttttagatgtgatagtatttttttttattttatagattgtttttttattttgttgtttgttttttttgttgtgtagaagtttttttgtttgaggtaattttatttgtttatttatgtttgtttttttgtttgtttatttgtttgttttgttttttgagataggattttgttttgttatttaggttggagtgtagtggtgtgattattttttattgtagtttttaatatttgagtttaagtgatttttttattttagtttttaagtagttgagattataggtgtatgttattatatttggttagttttttaaattttttatagagatggggtttttttatgttgtttaggttggttttaaatttttgggtttaagaaatttttttattttagttttttaaagtgttgagttattgtatttggtttttatttttatttttgttgttagtgtttttgagattatatgtaaaaaattattgtttagattaatgttatatagatttttattatttttttttagtagttttatatttttaagttttatatttaaatttttaatttattttattaataagttaatttttgtatatggtgagagatataggtttagttttattttgttaaatgtaatgatattttgttttgattttgtttaaaataatttagaagagtagggtggggaatgtttgagggaaatggaggggtatagatgtaataagattggttaagggttgataattgttgaagatgagtaatgaatatatggatgattattattttttttatttttgtatatgtttttatatataatgtttatgaatagtttttaagttttataatatattgtattggtaaaggtgtaaagaaatagatatttttatatattgttgttgaaagtataaattggtataatttgtatggtaaggattttggtaatatgttttataattatgagggtataaagtgttggattagtaaatttattttaaggattgtattttgtgggtagatttatttttggatagagtgatgtatgtataatttatatataatttgtagttagagattagaaaaaaatttttaggttaattagtaggagattgttgaattaaattatggtttatttatatagtaggatattatgtagttattaaaatatatgagaatgatttttaagatatagagttaagtagaaaatataaggtaaagaatagagtatagagtgggtaattttgtgtgtgaagaaaaaaatgggggtaaaaatatgtgtagttgtttatttgggtatagattatttttggaagggtatttagaaaattggttaggtatggtttttggatggttgaggaattggggtgaaagggagtattttattgtttatttgtttatattttttgaatgttttatttttatttatttatttttaggatagggttttattttgttgtttaggttggagtatagtggtttaattatagtttattgtaaatttaaatttttggttttaagtgatttttttattttgattttttaaagtgttgagattataggtgtgagttattatatttggtttttttgaatttattttttattttaaaaattgtttatatagatagtatattattatgttgtttaggttggtttttaatttttagatttagtagtttttttgttttagttttttaaagtgttaggagtatagatttgagttattgtatttagttttttttttgaatttttaattatgtaaatgtattttttatttggaattatgaatatattttggaatagataaatttttaaataattagtaaataaaatatgtaagaaatgttaaggggaaagttttttttagtttttttattgtttttttaagagttttgttgttattttttttttttatttggagattttaggaggatgggatgagggggatgtttagggtagagtagttttaattttttaaagttttgatgagtttgtgataagttttggattatattaagagaatagagaatttggtttgtgtatgggttttgtagatttaatttgttttttagtagtagatgaggtttgataaagtttttgaattggtttagttttaattttaagaattagttttttattagggattagatgagtagggatatgaataagagagttatattttagggttgtagaatttattgggtatttgaaattagaaagtagttgataagaggaagttttttttgatagtatggtagagttgttgtggtagttgaattttaatttggttgtatattagtattttttgggggattttagaagtttggtatttaggttatagtttagtttagtgaatttagaattttagggatagggttttggtgttgtttttaggttttttaggtgattgtaatgtgtagttgagtttaagaataagggttgttggattttattatttggtgatatggtataggttaaatttatttttagaagttagatggtttttgtttttgaatgttaggggttttttttggtaggttagtgtgaaaggttaagtatgtttgtagtagtttatatttagttatatgaagtggagttagatttttagattaggagttggggagagtggtagtgtgttgtaatagggataggaagtattattattttttatgggtatttttggggattagtaagtaggtgtgattagttgaagggggtagtaaaaggggttagttaggaaaggagatgtttatagttaggggtagattattgagagtttttgtagaggtttaggatgaggtgtaatggagttgggttttgttgattatataaattgaggatgaagtaggaaagtgagaataaagttataataattgtaataattaggtattagatgatagaggggtttgggggagggaagatttaagagagattgaagaattaagtgaagattttggaggtagtttggatattggtggaggtagtttttagattaaaggtgtggattagtaaggtttaggtttgtgatgtgatgttagggttatttgtatttgttttgtgaaaatgtttataagatagttaaatgatatttgatattattttatagaatgtaagaatatgtgtttatttagaagttattaaggttgtgatatgggatgggattggatatttgagttatgaaaatagagataaatgtaagtatgtaagtagttgaggaaatatatgttaatgtttgattatttatttttattaatatagtatgttttggggttagtttaaatattgaaggtaggattttaaaaggaggttgtttaataaagttgatggttgtaatggttttaaagaaaagtagattatttaatagtgtggaagatattgtaaaagttagtatttagattgtaaattttttttttttaaatatttattttgtaatgtgaaggaatttaaggattatttagttatatggtaatgaaaaaattgaggtttatttatttagtaggtatttatttagttattattaggtattaggtgaggttttgaaggttaaggagagtaagttttagaatatttgtgaagagttgattattgataggaggtataaggaatattattattaagtgattgggatataaagtgataagtgtgtgagaaggttttatttaggaggtgagttgagtgggtttttttttgggtttttaaagtatattgttttttttttatagtaatatttagtgttataggtgttagtatatgtgtttgtttttaattttgatttatttttggttataagtttttgaggtatgagagttgtagttttagtgtttatataagaagttatttagtatgttagggatataaatttatgtttataagattttggttagtaatagaaatgagtgaaatgttttttttggaatattttgaaatgttattttttagatgtattttttgttttttgggtataaataaatatttttgttatgagaaaaataatggtgtgagtatgttaatggatggtgttagtgttgatggatggtgtgagtatgttgatggatggtgttagtgttgatggatggtgtgagtatgttgatggatggtgttagtgttgatggatggtgttagtgttgatggatggtgtgagtatgttgatggatggtgttagtgttgatggatggtgtgagtatgttgatggatggtgttagtgttaatggatggtgttagtgttgatggatggtgtgagtatgttgatggatggtgttagtgttgatggatggtgttagtgttgatggatggtgtgagtatgttgatggatggtgttagtgttgatggatggtgttagtgttgatggatggtgtgagtatgttgatggatggtgttagtgttgggatgtttttgggattggtggagttgggtatttaggataaggtatatagggtttgtttttagttttggttaataggtttatagtgaattttggttttggtttttatattttttagttttttaaaggattggaaatgtagaattttatataaaatttttattttttttttttttttgagatggagttttattttgttgtttaggttggagtgtagtggtgtgattttggtttattgtaatttttattttttgggtttaagtgattttttttttttagttttttgagtagttgggattataggtatatgttattatatttggttaattttttatttttagtagagatggtgttttattatattggttaggttggttttaaatttttgattttaggtaatttgtttgttttagttttttaaagtgttgggattatatgtgtgagttattgtgtttggttaaatttttttatttttaaatgttggtttagaaaatgttaagtgttgtgttaaataaatattagtagaatttggttaaagggtagttaatttgtaatttttgaattatttagttatttgttataataaagaaggattgaatgagtgaatgtagttatatttgagttagggtttgaaggataagagaggtgatattgtttgtttagtatggtataggtattagtgatataattagaattataatattggatttttatatatttatttttatttgggttgtggtagttgtatagagagtttataatattttgtgttttgtgtgtttttaattataggtatattttagtaagtttttttgggggttattttttttgatggatttgtaatttttttagttagtaatttgtgattatttattttgaaatttagtggtggttagtttgttttgggtataatgtagaatttgttaatattgaaatttatatttttgtagatgaatttggttattttgatttttttaatgaggtagtaattatagtttaatattggtgatattgtagttataggagaatatgtgtaagagaaataataggttatttttaataggttttattgttatgttttttttgaggtatagttagagattaggatagttggttttagtttagtattttatgtagagaggatgagtggggatatgttttgattttatatttatttgggttttgtttaggttgttgttggttatatggtaatagtgttatgggattttatttatttttggttagagtagtagaagttagtgtttattgtggatttatgtttagttagggttatttagtatggtttttgggggttatggtagaagtaagggggattatggttttaaattttagtttatgtttagttgtagaagtttgttgttgagggagtttagttgaagttagttttgttaaggatttttatttttatagttatgaggataatgatgatttgttaggattttttagggtgtataggtattttttttttgtttattgtggtataggtttttttagggatgtttataagttagtaaaatttatggtggggttagttggattgttggttttattttttgttgtgagttaatttttattgagaaaatttaaaagtaagtagaataattatggtttgatattgtggatggttatagaagttgttagtagttttttttgtaggatttatggtttttgtttaagagagttaagttgtgtgttgatataaagggaatttgagaggtaggtagtttttatggggattttttaattttaattgaatttgtgggaagttatggtgtatatttatatgttagtatggggggtggtttttgggtttgtagggggattagaagtgtgtgggttgattgggtttttattaaaataaaattattaaaatttttaaggtagttgggaaaaaattggataatgtattggtaggttattttaggagttattattttatttttttttgggaatatttttgtgtatgataaaagtgataagtgaggattttgggagtagttagttattagggtttgagtttagttggtatagattttagttttgttagggttggttttgtaagtgttttttgggttaaagttatgttgatggtaggaaaagggtatgtgaggggagtaggttgtaagggtggtgattttaggtaagtatgttagagtttggggggaaatgatattatttatttagaaaggttaggtggggttatgtttggttttatggtttagaatttttttggtggatagtagagaaatttttgagatttttgaatggggtgatatgattagagttgtttttaagataaatattgtgatattaaagtaggaaggttggttggggggttgttgttgaggtttaagtgaggaatagagagggtttgattgaggagaatggtagtatgaggagtggggagatagtaggattagtgtttgggtggaggtggttaggagaaaggagttgttaaggttttgaggatatattgttggtggagtatgaggagtttttaaggattgttgatggggggagtttaggtttaggttgtagatttagggtgggagttagtaattggtagtaagtttagtaagtgattttgaggtaatttttaaagtagtagtagtattgttattgttattgttattattattattattatttttttattattattattattattattattattattattattattattattattattattattattattattattattattattattattattattattattattattattattattattattattattattattattattattattattattattattattattattattattattattattattattattattattattattattattattattattattattattattattattattattattgttattattattattattattattattattattattaatattattattattattattattattattaatgaatttataaatattgaatttatttagttttagagtgaagtatggtgtggaaggtgggaggatttgtaggtagtggttggttgtggtggtgttttgtagtgtaattattatttgttgaaaggtaagatgattttttttagatagtaatatttatagatgaaatgatatgatgtttaggatttattttaatatgagaagggggtagaggtagaaatgaaataggtttggttatatgttggtaattgttgaagttggttgaggggtatatggggatttattatgttattttatgtatttttgtttgttttgggaagtttttatagtaaaaaataaaatataggttaggtgtggtggtttatgtttgtaattttggtattttgggaggttggggtaggtggattatttgaggttagaagtttgagatttgtttggataatatgaagagattttttttattaaaaaaaaaaataaaaaaattagtttaaaattttaaaaataaataaataaaatataaggtaaaaatgaaggtaggaatagatttgttagaattttgagtttaagttaagttattgtattttttgtgatttgtaggtatatgtttagatggtttgaagtaattgaagaattataaaagaagtgaaaatgttttgttttattttaattgatgatattttattataaaagaagtgtaaatggttggtttttgttttaattgatgatattttattataaaagaagtgtaaatggttggtttttgttttaattgatgatattttattataaaagaagtgaaaatggtttatttttgttttaagtgatgatgtgattttatgaaagttttttttttggttaattttggtttaaaaagtttttttattgagtattttgtaatttttatttttgtttgttagagaataaattttttttgattgtaatttttttttatttatttaaattttataaaatagttttattttatttttttttgttgattttttttttagatttagtttatttgtatttaggtgaaataaatagttttattgtttatataaagtttgtttggtggtttttttatatggatgtatatgaaattatttatgattttaggtttttagattgatgagtttaagaaatattttattaattttaaatttggtaagtggtttttttttatttttttttttaattttttttattattttttaatttttttttttttttaattttggtgttattttttaatttttttttttttttaattttaattttttttattttttggtagagataaaggagatatgttttatttgtggatttaaaattttggtgttggttatggattgggaaggtagtttttttgtagtgtttaattattgtagggatatttttttgattatttatttatgttttaaaggtgttagattatgtagggaggtttgttttggttttttatttttagtggtaagttttgtttttttgggggaggggtaagtattttaattttttttttttatgtttttattttttttttgtttttttgggggaggggtaagtattttaattttttttgagtttttattttttttttgtttttttgggggaggggtaagtattttttaatttttttttttttatttttagtggtaagttttgtttttttagggggtaagaatttttaattttttatttttatattttaattttttatttttgtgttttaattttttatttttgtgttttgattttttttttatttttttggagggttaagaatatttgaattgggatgggttttgtggggtttgagggtaaggagtagttgtttgttttggttttttaaagtgttgagattgtagtttttgtttggttgttattttgtttgggaagtgaggagtgtttttgtttggttgtttattgtttgggatgtgaggagtttttttgtttggttgtttagtttggaaagtgaggagtgtttttgtttggttgttattttatttaggaagtgaggagagtttttttttagttgttattatatttaggaagtgaggagtgtttttgtttggttgtttattgtttgagatgtggggagtgtttttgttttgttgttttatttgggatgtgaggagtgtttttgtttggttgagattttgtttgggaggtgaggagggtttttgtttggttgttttgtttgagaagtgaggagattttttgtttggtaattattttgtttgagaagtgaggagtttttttgtttggtagttgttttgtttgagaagtgaggagtttttttgtttggtagttattttatttgggaagtgaggagtatttttgtttggtagttattttgtttgggagggaggtgggggggggttagttttttgtttggttagttgttttatttgggagggaggtgggggggttagttttttgtttggttagttgtgttgtttgggagggaggtgggggggttagttttttgtttggttagttgttttgtttgggaggtgaggggtgtttttgtttggttgtttttattgggaagtgaggagttttttagtttggttagttattttgtttgggagggagatgggggggttagtttttttatttggttagttgttttgtttgggagggaggtgggggggttagttttttgtttggttagttgttttgtttgggaggtgaggggtttagttttttgtttggttagttgttttatttgggaggtgaggggtgtttttgtttggttgtttttattgggaagtgaggagtttttttgtttggttagttgttttgtttgggagggaggttggggggttagttttttgtttggttagttgttttgtttgggaggtgaggggtgtttttgtttggttgtttttattgggaagtgaggagtttttttgtttggttattattttgtttgggaggtgtgtttaatagtttattgagaatgggttaggatgataatggttgttttgtggaatagaaaggtgggaaaggtggggaaaagattgagaaattggatggttgttgtgtttgtgtagaaagaagtagatatgggagattttttattttgttttgtattaagaaaaatttttttgttttgggattttgttgatttgtgattttgtttttaattttgtgttttttgaaatatgtgttgtgtttatttagggttaaatggattaagggtggtgtaagatgtgttttgttaaatagatgtttgaaggtagtatgtttgttaagagttattattaatttttaattttaagtaattagggatataaatattgtggaaggttgtagggttttttgtttaggaaaattagagatttttgtttatttgtttatttgttgattttttttttattattgttttatgattttgttaaatttttttttgtgagaaatatttaagaattattaataaaaaataaattaaaaaaaaaaaaaaaaaaaagaatatttgaattttttttttttgtgtttttatgtttttttttttttgtgtttgttttttttattatgggtaattttttattttttatttttttttttttttttttagtttgtgtttttaagaatttaaaagttttttaatttatatttgatttaaaatttaaatgttttgtttttttttgtaatattgtttggttttaatataaatttgatagtagttttaaatagttggaaaatggtatttttaatttttttattttataagatttaaataattgttataaaataggtaaatggtttgaggtgtttgatgtttaggtatttttttatatattagtttttttttagtttttgtgtttaatgtaatttgttttaaatttttttttttttttttttgtttgtttttttagttttaattttaagtattattgagtttttttaattttttttttttatagatttatttgattttttttttttttattaggttaagttaggttttaatttttttttagtttttgtttttttattttataatttttttattattttttttttttatatttggtttggtttatagttttgttttgtgattagtttttttttatttgtttagtaatttatttttaaaaaggtggttggagttaaaggtatagttaaggttaatgtttttttttttttattttaaattagatagtatttaggtttttttattaaatataaaaatttagtttagtttatggtttttttagtagtaattttgagatgttttatagttttagattttaaaaggttaaagggttattttatttttaatatatattttattatttaatttgtttttgatattaaatataattttaaaaattaaattttagtttttaaattttataataggatttaattagttttatttttaaggtgtataataatagaaaaaagttgtaattttttgtttttattgtgagataaattttagttatatttttagtatatgagaatttttaaatgtttgaattgtagtagttaggtatttttttagaatttttttttttaggagtttgttatgagtgttagaaatttgattattaggttaaggaatgtttgtaatttgggattttttttaagttatgttttatttgtgtgggattttattggaaattggattgtttaatttatttggtagttatttttagagtttttggaattttggtttaaggttttttgattgatttttttttaggtttttttggtttagtgtttgaagattgatgttgtttgattgtttttaaagttttttagattattatggatattgagttttgggtaatttttatagtggaaggtaagtttgttttttttttaattaatatggaggttatttattttatattattttatttttaagggtttgttttttttgtttttataattgttgtgggtattgatagttaggtttttaaattttttaaaattttttaattttggtgttaatttagataatatttttttaagtattttttttagttatttttatttgtttagtttttttattaggttgagatattttaattaaattatttgtttttttgattatttttggattatagttatattttattgttgtttttttttttaatttaaagttttttttgggttttttttttgtatttttttattttaatttataagtataagatatttttattttttttttggtgattgattatgtattttttattattttattaaaatttaattatttttattttgtttaatgttaatattttattttatagtatgttttgaaaggattaaagtttgttattatttgtttgttatagtatggttttttaaagtttataaattttttttataatttttttattttatttgttttaaaattagataagttttataagttagtttaggatttatgttttattaattaaattgttttgtttatttattttatggtgttaaatttatatatttttttgtttttaatatttttttttattatttattattttgttttggattttaaatatgttttttttattatttttttgtattttttattttagtttttttttgtttttatttagattgattttgatatttattaggtttagtaaattatttgggttgtattgttgtaagattttatagatagattttattattttagttaagtttaaattttgtttttatttgttatttattttggtataatttttataaaaatatatgtgttttttttgttgattgtgtttaattaattttttaaattttaatttgttataaaataataattttttttttttttaggtatggttagtgtagttggattttttatataagagttaggattgtattttgtagtttttttgtttaaataatttgattttattgttttagtttagtttttatgtttgtgtgtagtggttgttgttgttttaatatttttagaagttttaaaaattataaattatgtttaatttattttttatattttttataatttttaaaatttatttttttttttatatttgatgtatatattttttgttttttggtttttttagttgtatttattttttgttaagttttatagttattattgtttttggtttggattttaatttggttttttatattatttttgataatatatttgatttttatgattgtatttttttgatttatttgatatttattttatttttttatattttttttttttttgttttttattttgattatgtttgatttattgatggtagttttattaggtttaattgttatatattagtaaaggtaggttatgttatagtataagttattagtttgttttttagaattttttattttttttttattgtggaaatttatttttgaggaaataattttttagtgttttatttgttattttattattttttagggattatttaggtttttttttttttttatatattaagtttgaagatttgtttttatttaggattggtaaattagttttatttaatatgttttgagttagataattaaaatattttttagtttaagtagatatttttattagataagtagaggttttttttatagggtttgagaaggttattttagtaatttttttttttttgttagatataattttttagtttagtttttttatttttatataatttgataatagattagtttttatttgttaaattagttaagtagttttttaggaaatttttatattttttatggttttttgtttttaagaaaagtagaatagattaaaggttttttaaaaataaattttattaagtttagttattaatttaaaaaggattggataatatttttattattttttttttttagaaattagatttgtttttggaatgttataaggtatagtttatttgagtttttttttattaggttttagttttattttagatattggattaatttagattgtgttttaaaaatatttgttatttttattattttttgtttagttatatttttattttttatttttaattatttatatatgttttgtttttgtttatattgttggtttatattgtttttttaagttattatagttgatatttttttgtgttatttttaaattgttatttttaatttttgaagtaaataaataatttttgttggtaggattatgttgaatttttttaggtattttttaattagatgttttaggtttttttagtttttagattttttatatttgttttttttttttttttattttatttagttttttaatttatataaaattgtatttaggttattattaataattttatataataaatgttttttttaataattttataatattattttttattatagaatttttttttagtttaattttttttattttaggtttttatgttgtttttaattttgattaaagtagttttgagaaatattgtttattattgttttatattattttttaaaatttttgttgttttaatattttattattattttgttttattttttttattaatataagaaggtaggaatgttaggtttttgagtttaagttaagatattgtattttttgtgatttgtatgtatatgtttagatggtttgaagtaattgaagaattataaaagaagtgaatatgttttgttttattttaattgatgatattttattataaaagaagtgtaaatggttggtttttgttttgagtgatgatattattttgtgaaagttttttttttggtttattttggtttaaaaagtttttttattgagtattttgtgatttttatttttgtttgttagagaataaattttttttgattgtaatttttttttatttatttaaattttataaaatagttttattttatttttttttattgattttttttttagatttagtttatttgtatttaggtgaaataaatagttttattgtttatataaagtttgtttggtggtttttttatatggatgtatatgaaattatttatgattttaggtttttagattgatgagtttaagaaatattttattaattttaaatttggtaagtggtttttttttatttttttttttaattttttttattattttttaatttttttttttttttaattttggtgttattttttaatttttttttttttttaattttaattttttttattttttggtagagataaaggagatatgttttatttgtggatttaaaattttggtgttggttatagattaggaaggtagtttttttttgatgtttaattattgtagggatgtttttttgattatttatttatgttttagaggtgttagattatataaggatatttgttttggttttttatttttagtggtaagttttgtttttttaggggaggggtaagtattttaattttttttttttgagtttttattttttttttgtttttttaggggagaggtaagaattttttaatttttttttttttatttttagtggtaagttttgtttttttagggggtaagaatttttaattttttatttttatgttttaattttttatttttgtgttttaattttttatttttgtgttttgattttttatttttgtattttgattttttatttttatgttttgattttttatttttgtgttttaattttttatttttatgttttgattttttttttatttttttggagggtaagaatttttgaattttttttttttgtgtttttatttttttttttttttgggtttgttttttttattatgggtaattttttattttttatttttttttttttttttttagtttgtgtttttaagaatttaaaatttttttaatttatatttgatttaaaatttaaatgttttatttttttttgtaatattgtttggttttaatataaatttgataatggttttaaatggttagaaaatggtatttttaatttttttattttataagatttaaataatttttgttaaaaaataggtaaatggtttgaggtgttttatgtttaggtattttttatattttgttttttttttagtttttgtttttaatgtgattttttttaaatttttttttttttttttttgtttgtttttttagttttaattttaagtgttgttgaatttttttagttttttttttataggtttatttgatttttttttttttttttaggttgtttatggttaggttgagttaagttttaatttttttttagtttttgtttttttattttataatttttttattattttttttttttatatttggtttggtttatagtttagttttgtgattagtttttttttatttgtttaataatttttttttagagaggtggttggagttaaaggtatagttagggtatatgtatttttttttttattagattttttttaaattagttagtgtttaggtttttttttattagattttattaaatatatataggaattttgatatttaattttgttttataatttaatttggagtgatttaaatgttattttgatttttattttttttttagatgaataggaaagagttttttttttagtttaattttatgttgataattgttggttttatgaatttgatttttaggaaggtattagagtagttttttaagaggatttttaatggaattattagataaattttttaggtatagttaggtaagattatatgattttttgtttagttgaaaggtttaaaaaggtagtttataaagttgttaattttgataagtttaaagaaattatttaaggtaaagatgaaaatttagtttagtttatggtttgtttaagtagtaatttttagatgttttattgttttagatttagaggggttagaaggttgttttatttttaatatgtattttattatttaatttatttttgatattaggaaaaaattttaaaaattagaatttggtttttaaattttataaataggaattaattaattttatttttaaggtgtataataatagagaggaagtagttagatggtaatgtatttttgagttataattatttgtttttgttgtgagataaaatttagttatatttttagtatataagaattttaaaatgtttaagttgtagtagttaagtatttttataagattttttttattaggattttgttttaagtgttagaaatttggttattaggttaaggaatgtttgtagtttaggattttttttaagttatgttttatttgtgtaaggatttattggaaggtagattgtttagtttgtttagtagttatttttagagtttttaaagttttagtttaaggttttttgattgatttttttttagatttgtttagtttagtgattgaagattgatgttgtttgattattttagaatttttttagattattatagatgttgagttttaggtaatttttatagtggagagtaagtttattttttgtttaattgatataggggttatttattttatgttgttttttttttaaaggtttgtttttttagttttaataattgttgtaggtattgatggttaagttttaaaatttttgaaaatttttttattttggtgttaatttgggtaatatttttttatgtatttttttttagttatttttatttgtttagtttttttattaggttgagatattttaattaaattatttgtttttttgattattatagttgtattttattgttgtttttttttttaatttaaagttttttttgtgttttttttttgtatttttttattttaatttataagtataagatatttttattttttttttggtaattgattatatgtttattattattttattaaaatttaattatttttattttatttaatgttaatattttattttatagtatattttaaaaggattaaagtttgttattatttgtttgttatagtatgggtttttaaaatttaaaaattttttttataatttttttattttatttgtttaaaaattagataagttttatagattagtttaggatttgtattttattaattaaattgttttgttatttattttgtggtgtttaatttatatatttttttgtttttaatatttttttttataatttagtgttttgtttttgattttaaagatgttttttttattatttttttgtattttttattttagtttttttttgtttttatttggattgattttgttatttattagttttagtagtttatttgggttgtgttgttgtaaggttttagggatagtttttattattttagttaagtttttttttgtgatttattttttttttatttttttgttttttattttatttaatatattgatgatttttttttttgtagttttttttttgaatttttttaataagatatatttttgtttttttaatatttattttttaaaggatattaggtatttttttttaaaatttaaatgttttttttatttattatttattttggtataattttttataaaaatatatgtgttttttttgttaattgtgtttgattaattttttaaattttaattttttttataaaataataattttttttttttttaggtatggttagatatttttgtttttagatatttggttttgttattttaataaaattattatataaatttataaaaggaaatttagttgattttatagattttaaattttttttttatttttttttttgttttttgaagatagttttagagattgtttttattttagttttttttgatttattttaattttttttattatatatagttgaagtgtagggttgtgtagttagaatttttatataaggattaggattgtgttttgtagtttttttgtttaaataatttgattttattgttttaggttggttattatgtttttgtgtagtggttgttgttgttttaatatttttagaggtttttaaaattataaattatgtttaatttattttttatagtttttataatttttaaaatttatttttttttttatatttgatgtatatattttttgttttttggtttttttagttatatttattttttgttgaattttttatagttattattgtttttggtttggattttaatttggttttttatattattttagatattatatttgatttttatgattgtatttttttgatttatttgatgtttattttatttttttatattttttttttttttgttttttattttaattatatttggtttattgatggtagttttattaggtttaattgttatttattagtaaaggtaggttatgttatagtattttttatatttattattgaggttattattttgtttttttttattattttttagtaagttagattagttgttttaatttaagtttttatttttggaaaaggattatgtgttaatatttatattgattttaaatatgttttttatattttgtattattatgtggttatataggttgaaagaggtttttttattatataagggttttttattattaatgtttttttaataaaaattttatttaaggtttttttatttttaaaggaggttaaggttatttattgtaagaggtattaaaaggtgttagattttattgttttaagtaatgtttatgttgataaggtggttagataagtagttagttttttaatttttgttttttagggttagttttttttttttatattggttatttttatttatttttttgttgaaatttttatttattaatttttttttatataaggtaaatagtttttagattaaggaaaatatttttttttagttttataggtttattttattttgttgttattttataattttttttatgtaggttataagttgttagtttgttttttagaattttttattttttttttattatggaaatttatttttaaggagattatttttaaattaagtaagtaattgtgttgaatttttttaggtattttttaattaaatattttaggtttttttaatttttagttttttaatatttattttttttttttttttatttagattttgtattttttgtttagttttttaatttatttaaaattatatttaggttattattaattattttatataataaatgttttttttaataattttatgatattattatttattataagatttttttttagtttttttttttttattttaggtttttatgttgttttaattttgtttgaagtagttttaagaaatattgtttattttttttttttatattattttttaaaaatttttgttattttaatattttaatattattttgttttattttttttattaatataagaaggtaggaatgttaggtttttgagtttaaggtaagttattgtattttttgtgatttgtatttatatgtttagatggtttgaagtaattaaagaattataaaagaagtgaaaatgttttgttttgttttaattgatgatattttattataaaagaagtgaaaatggttggtttttgttttaagtgatgatattattttgtgaaagttttttttttggtttaaaaagtttttttattgagtattttgtgatttttatttttgtttgttagagaataaattttttttgattgtaatttttttttatttatttaaattttataaaatggatttattttatttttttttattgattttttttgtggatgtagtttgtttgtatttaggtgattaaaagtttttattgtttatataaagtttgtttagtagtttttttatatggatgtgtatgaaattgatttattgtttaaaataataattattatttatgagtatttgttttgtatttttttaattttgtaataattaggaaaggtgggaattgtttttattttatagttgaagaaattggagtttaaagaggtattagttaggtttgagtttaggatatttggttttaaagttttgtttattttattttttatttattgttttttttaatatgtatttttgaattattttttttatggatataaagagtgttatggtatttttatgttaggatgtaattgggttttttatgtaatttatttattttttttaagttttatttttttttttgttattttagattgggagatttttaagggtaaggtttagatttaattttttaattgtatttagtatagtgtgtagtatattaatataggtatatattttttgttaatattttgtgaaatgttatattagaaaataatgtataaattataatatgatagaagttatgtttttattatttagtttaagaaataaaatattatagataaagttgaaattttttattagttttttattagataaaaattgatataaatatgaagtatgtttttttatttttatttatagatttgtatttttaaattagtatttatattaatttttggttaatattatatattatattaatttatttgtgaaatagttggtgggaattagggtgtgagtattatgggatggtattgttataattattaaggtttttattagtggttaattgaaatgaggtgtaggtggaaggttagggagtgaaatatggtagttgtggtggttgtaaggtttgggatagtgattattataaggattgtggtatggattggttttttttaatagtattggaagttttggaggaaaaaaataataggtttagtagagttaattgttaatttaaggtttgttgtgaagatattttttgtgtttttgggttttaaagaattggttgtgtgtgtgtgtgtgtgtgttgttttttattgtttggtttggtttgttgttttttatttagtatttttgtatttatgtttttaagattggtatatatttttatttggtgttaaggtaattaggtttattatttaataatgatggtatattttttttttttttagtttttgaaatagttttataaaatagggaatagtttgaatgttttataatttgtgtttgtaaaatgatttgggtttggtgtttttttttgtggaaagttttgggtttttttaaattgtttttttttaagttggatagttatatggtttaaagagttagagtttgataaggttttgaaaatagaatattgttttttttttttggttttattttgttattttttattttttaaagataaatatttttttattttttagttgattattttggtatttatttttatgtttttaaatagtatattatttttgtttagttttaggtattaattatagatggaggatatggatattttttttttttttttttatatttgatttattatatgatatgttttttttattttttatgtttttaatatagttatattatattattggttagattagtaatttatgttatatttaagttattaagtaattgttatttatagttgagtatgaggtgatttttttttttgttttgtataatttttggtttttttggagtgaataattaattaattattttgtttgttttgtgtttattaataatttaatttttttttattattttataaattttttttttatatgtttaggtgtattagggattttttttaatgttatttttataaattaattttttttagagttttttggttttttttaatttgggttagttgtttattatatttattgttattatataggataatttttagagtagttttaagatatatttataagttttttgatattgtttttattagagatgaagtttaggttggatattggtttatgtttgtaattttagtattttaggaagttgaggtgggtgggttgtttgagtttaggagtttgaaattagtttgggtaatatagtaaaaatttgtttatataaaaaatataaaaattagttaggtgtggtggtttgtatttgtagttttagttttttgggaagttgagttgggaggagttgtttgagtttaggaggtagaggttgtagtgagttaagattatgttattgtattttagtttgggtgatagagttagattttattttaaaaaaaaaggttttaaaaaaaaagaaatgaagtttatatatttttttttgaatttggatgaattttagtgatttgtttgtaatttatggtatgtagaggatgtagtgttgtgtaatttataagattaggttataaaatgtgatgtaattttttttttgtttgttaggatatttatttagaagtgtagatatttggttaggtataatggtttatgtttgtaattttaggattttgggaggttaaggtgagtgaattatttgaggttaggagtttgagattagtatggttaatatggtaaaattttttttttattaaaaatataaaaaattagttaggtgtggtggtgtgtatttgtaattttagttatataggaggttgaagtgggagaattgtttgaatttaagaggtagaggttgtagtgagttaagattttgtaattgtattttagtttgggtaatagagtaagattttattttaaaaaaaaaaaaaaaaaagtgtagatatttatttgtattgttatgtaaaagtttgattaatttgagattgttatattgtaaggaagtatagtttatatagagaagttatgtggtgtagatattttggtagatagttttagttttttatttataatagtattaatagtattaattttaatttttatgttatttttaagtattgattttttttagtaatggttttagatattgtggaataagttatttttattgtgttttttttgaattttttatttaaagaatttgtaagtatgataaaatgattgttttaagttgttgagttttgggaaattttgttttgtagtaatattaattgtaaaattttttaagagttattaatttggagattttttttattttttttttatgttggattttttggtattatattttatgtttttttttttattggtttttttatttttattaaagaagtatgttttttgggaggttttagagaaagggtatatgggatataaatttttaaagattgaaaatttgaattgtttttatttttatattttatagtttagttgggtaaataattgttatgaatattaaagggatgagaattagataagtaggtaaagattagaggaaagattgttttatagtagtttatgtttattttatttatagttttaggatttttaggttttgagtataggtttttatagtaggtatttgaaagttttgaagaagaatattttttataagtttattagtagtttttttttttttttattttattttttaattgatatgattttagttttttttttttgggtgtttgttagtttttataattgtttttaaaatgtgatggttagatatagaagttttagatatagaagtataaaagataatatattattgttaagtttagggagtaagtaaaatgttttttttaatgtttagtatatagagttattatattggtttgttttttgttatgagtggttgagatattttttaagaattatggataggtaagtgttttttaaattataaaatgtaatttatgtgtatgtgaagggattgttattattaggtttagttgtttttgtatttggtgagtagagttggtgattgttaagtttggttttgatttgattttttaagaaggtgggaagtttttaaaagaaagaagttgggaaaaaggaatgaggaaagtttttgtttttgtaggaattattggatatattgttaagatgtagaggatagtaagaaggaaagggggtttaattatatatatatatttgtttatggtttaaaaagaaataatggaagaatgtaaattaatagaaatagttatttatagatattaggagagtataagaaagaggaggaggtaggaattaaagttagagggaaagttttattttgttttttaaatggaaaattaagttaataaatgtagatggaataatagaattagaaattattattttgtaagttttgattgaagaaaaaatggatttggataatagttatttggtagttatttaggttgttaattattaagtgaaagtttgataagaattttatagagaatgaattagaattttaatatttgatgttatttataattgattatgggaaatttagattttatgtttttttttgatggattgtaataagaaatatatagtattattaaggaagtatttttgttaaaaaagaggaaaaatggaatttgaattttattaaatttttatatttaatgattagtttgtggaaaatatggaagataaaagaatatgtttaatgttattataataatgtaattagttaaatttagggtgtatgaaattgtagtttttttaataaataaatggtatttttaaaaagtaggaggtgggagaggaattattattaattaaaggagaattaagagatattttaattaaatgtaatgtttagattttgatgtaaagaaattaaatataaatggatttttttttaaaataaatgaagattagatatagatgggtattagttgatattaaggaattattattaatatggttgggtgtgatagtggtattatggttattttttaaaatttttatttgttagagatattaattgatgtattaattgaagaatgatatgatattatattttttttttatgattttagtatatatatgtgtatatagatgtgtatatgaagaggttgtaggagtaatagataaaattagattggtaaaatgtagataattgttgaagttgtatattgggtatatgaggagtagttatagttttttttttagttttgtgtatagttaaaaatttttgttttttttttttttttttttttttgtatggttttttttttttttttttttttttttttttttttttgtatagttttttttttttttttttttttttttttttgtatggtttttttttgatgttgagtggaggttggattgtattgttgttattttgatttattataatttttttgtttgatttttttgttttagtttgttgagtgtttgtgattgtaggtgtgtgttgttatgtatgattggtttttgtgttttttggtggagatggggttttgttgtgttggttgggttggtttttagtttttgattatgagtgatttgttagttttagttttttgaggtgttgggattgtagatggagttttgtttatttagtgtttaatgttgtttaggttggagtgtagtggtatgattttggtttgttataatttttattttttagttgtttgttttggttttttaaagtgttgagtttgtagtttttgtttggttgttattttatttaggaagtgaggagtgtttttgtttggttgtttattgtttgggatgtgaggagtttttttgtttggttgtttagtttgggaagtgaggagtgtttttttttggttgttattttatttaggaagtgaggagtgtttttgtttggttgtttattgtttgggatgtggggagtgtttttgttttgttgttttgtttgagatgtgaggagtgtttttgtttggttgtgattttgtttgggaattgaggagtgtttttgttttgtagttattttgtttgggaggtggggggtagtttttgtttggttagttgttttttttgggaggtggtgggggagtttttgtttggttgttttgtttgggaagtgaggagtttttttgtttggttgttattttgtttgggaggtgtatttaatagtttatggagaatgggttatgatgttgatggtggttttgttaaatagaaaagggggaaatgtggggaaaagaaagagagattagatttttattgtgtttgtatagaaagaagtagatataggagattttattttgttttgtattaagaaaaatttttttgttttgggatggtgttaatttataattttatttttaattttgtgttttttgaaatatgtgttttgtttatttagggttaaatgaattaagggtggtgtaagatgtgttttgttaaatagatgtttgaaggtagtatgtttgttaagagttattattattttttaattttaagtatttagggatataaatattgtggaaggtggtagggttttttgtttaggaaaattagagatttttgtttatatgtttatttgttgattttttttttattattgttttagattttgttaaatttttttttttgagaaatatttaagaatgattaataaatattaaaaaaaaaaaaaaaaagaaaaaaaaaagaaaatttttataataaagattttttaaaaataagaaagtagatggggtgggagttgtaaagaaataagatgtttattttataaattggattaattttataatttgtgaaaaatttaattggtggtttagttagaaatattggagtattagtataattgtgggatgaaaaaagagggggagaaaggttgttagttttatttatataatgaaatagtaggtagtgattgattaatgtaaaaataaatatataaagattattaaagatatttataatatattatttgttggggggtttttggattttattgttaatgtaggttataaaataattttatagtatgatttaatttttgtgaagatataagtagttatatattttatttttaatatgtataggaaaaattttatatgtttaaatattaataagtaagtgggtttttaatataggtattttaaatattagttttttttaattttttttttttttttttttttttttttttttttttttttttttttttttattttttttttgatagggttttattttgttatttaggttggagtgtagtggtataattttggtttattgtagttttgatatttttgtgtttaggtgatttttttatttttgttttttaagtggttgggattataggtgtatgttattatatttagttagtttttgtatttaattttttttaataaaaaatattagttgtttaataaagaaatgttaatagttttaggtttattaaaattatgaatttatgaagtaatttattatttttataaggatagttattgatatataggtaaaggtatttttaaagaaaaattatagtttatattaattatttataattaattaaattttaaatgttgttattatttaagatttatgtttttaatgggattgtttttatttgatttagattgttttaatgtaaataaagggttaatattaatttttattttttaagatttttggtaggttagaaaagtataaatttaggattttggggaaggtttaaaggttatattagtgggtgattttgtagttttgttttgttttgatattgttattttgttttataagtttagggatttttatagttagattaaatggaggattatttaggttaatttttatgggttaggttttttgagagtttaagttagagaaagatatatttttgttttggttttgtattttggaatttttttattggtgttggtttttttggaggaaaaataagagatttgtttttatattgagtgttaggaggaaaaaaatggggattttttaggaagtggttttgattttttattttggtaagtagaagtttgtttagttttttttgtggtatatgtaagtggtttatttagtttttattttttggttgatttgttttttttgaaatatataaaagtatagagttaatgataggtaaagggattgtgtttgttgatattttgattaattgtatgatttatagatggttaatataagttttattttattttgtgatggatttattatagttttttatgttatttgaatgtttttttttttattgtttttttgtttttttaaatattgttttgtatagttttttaaattgattttgagaggttttttggttttttttttggttttaggagttaaattttatgttaggttgtttatagtgtggtttaatttatttttgaatttagtaagtttttttttgtatgaatttttaagttttttgtttagtttttttttttggatggaatgttttttatagttaaatgttagttttgaatatttaggtagggagatgtttatagtattaaggaaataaattgaattattgtaataaggtgaggaggtgggtatttttaagatgattaaataaaattattaaagttatagttagtttgattttttttttaaatttttatatttattatattagttataattgttttttaatatatgaattatttttggaatttattttatgtatttaaaatggttatgtgtggtggtttatatttattattttagtattttgggaggttaaggtgggagtattatttaagtttaggagttgatattagttttggtaatatagtgagagtgagattttatttttataaaaaataaatttaaaaatttgttgggtgtggtagtgtatgtttgtggttttagatgtttaggaggttgagtggggagaattattttagtataggaggttaaggttgtagtgagttatggttgtgtttttgtattttagtttgggtaataaagtaagatttggttttaaaaataaataaataaataataataaaatttaggattagagtgttaaaatattttttaatatggttaaagaatatgagtagattattgttatatatatatgtttgtatatatattttatatatgagtatgttttttgaagagtttatagaaggaatgaaagtttgtatgagttttttatattgttaagattattttttattttttggttaagtgtagtggtttatgtttgtaattttggtaatttgggaggttgaggttggtggattatttgaggttaggagttggaaattagtttggttaatatggtgaaattttgtttttattaaaaatataaaaaaattatttaggtatgatggtaggtgtttttaattttagttatttaggaggttgaggttgaagtaggagaaatgtttgaatttaggaggtagaggttgtagtagattatattattgtattttggtttgggtgataaagtgagattttgttttaagaaaaaataaataaataaataaataaataagaaaattatttttttaaaggttaaatgagaatatttattgttagtaagaatgtaattaaatggatattattataaattttttagtataatgtttggttaatttttaatatatgttagttttatttttattgatttgtataagatattgagtttttaattaattttaaaatattaagtggtggttgggtgtggtggtttatgtttgtaattttagtattttgggaggttgaggtgggtggattatttgaggttaggagtttgagattaatatggagaaattttttttttattaaaaatataaaattagttaggtgtggtggtatatgtttgtaattttagttatttgggaggttgaggaaggagaattgtttgaatttgggagatggaggttgtggtgagttaagattgtgttattgtattttagtttggataataaaagtgaaattttgttttaaaaaaaaaaaaatattaagtggtttagtattttatgatatttgattttgttattttttttttgttttatttttttatgtagtttagattattagtggaattttttttaggagtatttttaattttttagattttaatttttttattttaaatatttttttagtttttaagttttagagaattaaatagttttttaattggagttatgggagagtttgttttttgagtttagtatgttaggtaattttgataattggttatagaatttatatagggatttttttttgtttatgtgtggatttttttataagtttaatttgttgtttaagtttatattatagttttttattttatttatttttagaatattttgttttttatattataggaaattggtttaatgttatatatatgtatatattttttttgtttttttatttaggtttttttttattttgaaaggatgagaagttgttttttttttgtatgggaaaatttataagtttttgttttaatttattaggtatatgtttttttgtttttttatgtttttagttttttttttttttggtttaattgtaattttaagtatttatataatttttggtattgggtagtagatgtgggtattatagtttatatggagaagtttggattttagttatataggtgggggagtattagtaagaaattggtatgtttagatgtttagatttgatttttttaatagttattattgaaattaaagaaaaggtgaaaaaaatttttgagtaaggaaatggtagtagaggtggttaatgtggttttattgaattttttttaaatggtattagaggttttgagagtatagaagtattatttttaggtgtagagtgaaatggtattgtattggtgtagtaattttttggggagattaaatgatgtttttgtagtaatttgttgtttatatattatttggagatattttttattttatagaagggaaggggagaataaggtgtttttagttagattgattttgaagaatttatatttaaattttttttatttgttaagtttaaattatttaataaaatttttttttagaaatttgtgggaatgttgagatttaagaaatttattaagtatttattagttatttaaaagaggttaattattgggtaaagttgtgttgtattatttgagttaaaatattgttatagagaagtttataagaaaatagaattatgagaaatatggtagattgaataaaaggttttagttttttatttttgtttatatttaggtttttgattatgtgattttgtagtgtttgttattagagatagtgtatttttttatttttgattgtggttatgtgatgtgttttggttaatgagatgttagtaaaggtttgaaatgtatttgtgtagttgagtttttttttttgtggttttgttattattgtgataagagtttttttgtttttttattttagattttagggggaatttagagtagatttgagtttgatttatgaaggagatatgtttagttggatttatagtttggagttagtttagttagttaagtttagttagtttggttaattttttattgatttgtagatataggagagagaaaattttaagagaggaaaggtgataattaatgtttatgggtgatgagtttagaaatagtagtaaatatattattatttatataatatataaataatattatttataggtattttaaagaattaaaattagtaatggttatttttggtaagtggattgaggttgggagaggtgaggtggaaaaggtttttttaaaaatagattttatttttagattagttataggtttgtagtaaaattgagaggaaggtataaagattttttatatagtttttgtatgtatagtttttattattattaatgttttttattagagagatatatttgttattattgaagaatttatatagatatattattattatttaaagtttatgtttatattataggttatttttggtggtgtatattttgtgtatttgtataaatttataatgtataggtggaggttttttattttttattagaagtttttttaaattatttgatttttaaaaattatatatatttattattttgataaaaattaaagaaaaaataggaagaatataagatttttttagtttttatatagttttattattatttgttaattattgataggtaatgttggtttgggagtgggtatttttatattgtaaataagatagttgtttagttgtttgtattggtgttggtttgaggtagggatagtgtagatatatttaagagtaagtggttatgtttggttttgtggggtaatttagagtattagaaagtggtgttatataggggattaggattgggtagagagagtattgaaaaattttatttttttttattttattttttaatagatgtttttaggtaagaagatatgggagtgtttgtaagagtgaatggagtaagtaaatattattaggagagtttttggatatttttagggatgtgtaatttaagtatattttataatattttagatatattaagaggaataaagaataatatagtgggttgggtatggtggtttatgttgtaattttattattttgggaggttgaggtaggtggattatgaggttaggagattgagattatggtgaaattttgtttttattgaaaatataaaaattagttaggtgtggtggtgggtgtttatagttttagttatttaggaggttgaggtaggagaatggtgtgaatttaggaggtggagtttgtagtgagttgagattgtgttattgtattttagtttgggtaatagagtgagattttgttttaaaaaaaaaaaaaaaaaggaataatatagtgagtatttaagtatttataagttattgttaagatagttaatttttattatgttttattttagaaagattatttttaattttgtttttagttggggaaattatttattagagtatgtatgtattatttttatgtatgtttatatttttgaatagttatagatttttaaaaataaataaaatttttgtatgttttaaatataatatgttaaatgttattatattgtatgtgttttgtttgaattttttttttttgtggattatttttatttttgtgagatttatttatgtgatttatgtagttttttttttttttgagatatagttttgttttgttatttaggttggagtgtagtggtatgattttagtttattgtaatttttgttttttgggtttaagtgttttttttattttagttgtttgagtagttgggattataggtttgtgttattatgtttagttaatgttttgtatttttagtagagatggggttttattatgttggttaggttggttttaaatttttgattttaggtgatttgtttgttttggttttttaaagtattgggattataggtgtgagttattgtgtttagttgtgatttatgtagtttaaataattgatttttattgttttttagtatatgatagataataatttatttatttatttttttaatgatgtatttttgagttgtttttaggtgtttgttattttaagtttttgaatatatttttttgtttgtatatataagaagtttttaattggatttgttgttattaaggaggtttataaaaaggtagtggttttgtttattggtttttatttttttttttgatattattattattattttgatgggtgtgaaaggatatttttttggttttaatttgttgattattaagaatgagtatttttatttatttttttatttttgtaaatttttagttatggtttttgtttttttttaagtgagttgtttgttatttttttgttgatttttaattttttatatattttggatattgaatttgtttgttatatttgtttttgtggattttgtttttattttttttttaagatgaaagttagtttattaataaagtaaaggaataaaagaatggttattttataggtagagtagtttgtttttattttttattttaaaataaagaagtttaaaatttaatgtagttggttgggtatggtggtttatgtttgtaattttagtattttgggaggttgaggtgggtagattatttgaggttaagagtttaagattagtttggttaatatggtaaaattttatttttattaaaaatataaaaattagttaggttttgtggtatatgtttgtaattttagttatttaggaggttgaggtaggagaattatttgaatttaggagagagaggttgtagtggatttagattgagttattatattttagtttgggtaatatagtaagattttgttttaaaaaataaaaataaaattaaaaaattaaaaattattaaatttaattatagtattgtttttttttgagatagggttttattttattatttaggttggagtgtgatggtatgattttagtttattgtaatttttatttttttagtttaggtgatttttttattttagttttttaagtagttgggaggtgtatgttattatatttagttatttgtgtgtgtgtgtgtgtgtgtgtgtgtgtgtgtgtgtgtgtgtgtgtgtgtgtgtattttttgtagagattagattttattattttgtttaggttggttttaaatttttgggtttaagtgatttatttaatttggttttttgaagtgttgggattataggtttgagttagtatgattagtttgaattttttaatgtttttttttattgggtatttaggattttgttaaagaaggttttttatttttagagttatgaagatgtttttttatagtgttttttaggttttaaaatatttagagtttatttgttgtgtggtgttggtgagggttttaatttttttttttgtaatttagataattagggttatttagttaatagagttttagagtttatgttgttttttgttgtttatgtttttattgattgttttgtttatttgtttattttagaattatattttttttttaggattattttttttttgttggaagtatgttttttagtgagttttttgagttttatttttttgagttttttgttgtgataaattttgttttttatttggaaatgtttttattataagtagatttttgaataattatttattttaatgtttgattttaagttgatggtgaagagttttaagttatatttattgtattatatggtttttggtttttattgtggttgttataaagtttatttttagttttagtatttgttttttgtaatttgtgttttttttttggttgtatttaagattttttttttgtatttggtgttttgtagttttatgatgatatggatgtggatttttgtgttttttgtttttgtgtatttaggtttttataatttatagaaaatttttggttattgttattttaagttttatgtttttatatttttttgtttaaatgtgtgttgtgttttattttgatttttatattttttatgttttatgttttttatttttttggttttttagtttgtattttttttgatttttttttttatttattaatttaaaatttttagttaaaatgggtttgttgttaaatttatagttttatttattgtatttgttatttttagatgttttttttgatttttttttagtttgttaggttattttagtggttttgtggtttttggtttaggttgttttttttttttagtttgtaaatattttaagtatttttagtttaatttaggatgttaaaggttgggttttttgaggtttagttttgttgtggttttgttgatttatttgtggtggttttttttatatgtgtttggtaattttatttgtgagtttatgtttagttggttttaatttggggaaatttagagagatttgggtgtgttgggagtagttatttattatgtatgtttttattaagtttgtaaagaatattatttttttaatttgggttattttttagggttgtgtttatagtaagtggtttagaggaatgaggttatgttttttttagttaaagtgtaggtttgttgattgtttattgaaaaagtagtgagttttttaattttagtatgtattggttatgatattagttttattgtttgtatagtatttgtttgggttttttgtgttattttttgggaaatttgtgttagtaagaggtttatgttgtttgttgtgttttaaggatttaggaattttatgtttttagttaatatttgtgaaatattgtaggttagtagattagtttgtaaatagagtagaagttagatttagaaaaatgttagtgtttttaggtgtttgtatgttgtttttatggaggtaggagagttttttagtgtgagtttttttagattatgtagttgttattaatataaattttaaatttttgtttttgtttttgtttgtttgtttgtttttttgttttgtttttttttttagtatttattgattatttttgggtgttttttggagagggggatttggtagggttataggataatagtggagggaaggttagtagataaataagtgaataagggtttttggtttttttaggtagaggattttgtggttttttgtagtgtttgtgtttttgggtatttgagattagggagtggtgatgatttttaaggagtatgttgtttttaagtatttgtttaataaagtatattttgtattgtttttaatttatttaattttgagtggaaatagtatatgttttagagagtatggggttgggggtaaggttatagattaatattattttaaggtagaagaattttttttagtatagaataaaatggagttttttatgtttatttttttttatatagatatagtaataatttgatttttttattttttttttatattttttttttttttatttaataaaattgttattgttattatggtttgtttttaatgagttgttgggtatattttttagatggggtggttgttgggtagaggggttttttattttttagaaggggtggttgggtagaggtgttttttattttttggatggggtggttggttgggtgggggttgttttttattttttggatggggtagttgttgggtggagatgttttttattttttagatggggtggttgttgggtggaggggttttttattttttagatagggtggttgggtagagatgttttttattttttagatggggttgtggttgggtagaggtgttttttatattttagatggagtggtggggtagaggtattttttatattttagataatgggtggttgggtagagatgttttttattttttagatgggatggtggttgggaagaggtgttttttattttttagattgggtggttgggtagaggggttttttatattttagatgatgggtggttaggtagagatgttttttattttttagatggggtggttgttgggtagaggttgtaattttggtattttgggaggttaaggtaggtggttgggaggtggaggttgtagtgagttgagattatgttattgtattttagtttgggtaatattgagtattgagtgaatgagattttgtttataattttggtattttgagaggttgaggttggtagattatttgtggttaggagttggagattagtttggttaatatagtgaaattttgtttttattaaaaaaatatgaaaattagttaggtgtggtggtgtgtttttgtaattttaggtatttggtaggttgaggtaggagaattaggtagggaggttgtagtgagttgagatggtggtagtatagtttagttttggtttttataattttggtggtattagagggagattagtgagagggagagggggaggaggaggtggagggggagggagagagagggattttaaatttttgtaatgggaagttatgtttatatattttaggggagttttggttattttaatgtaagattttagataaatttttttttggattttagtggatggagattttattatttttgagggtgtagttttaattttatattttatggtttaaggttttagttttgtgttataatttgttgtttataggaggtagtggtttttgttattggttgatgtatttaaggttagttaggggtgtggggttttttttgtaataaatgtttttagaggttatggttttggttttagttttttttttgtttttggttgttgggagattttttttgtttatttgtggtttaattatgtatttatttgaattattttagtaatatttaaagttattaaagatgtagttatttttatagagaaagtagagtttgttgtgtaggtatttgtggttttggtgtggttttagtttgttttttatgttgaggttttatatttttattaatagggagtttttggttattaggtattgtttattatggttatattttatattgggtatggatgaaattatttttgagaagaaggatttattgttgggattttgaggttttttaaaaaatttggagtgtttgttgtatagggttgaggagtttatgttgtttagttaatggtttttttgttattattgtagataagtatattgtattggtatgagtggaatttggttgttataatgatttttgttagttgttttaggttagtaggtttgatgtttattatgttaaaatgtttatgtgtgatttttaagtgttataaattaatttttaggttattgatagtgttgtaattttaaatgaattttgaagttatttatttttattatttaagttataattttttgtttttttattttatttgttttttttttataattttatagttttattatttgtagagagtagaaaatgagtagtgttttgttgtaattatttaattttattttttgtttaatttttagatttttttaatagttaaattttggtttatgatttttaaaggtattgtaaatattatatttttttttagaatgagggtggtttttattttttagttttgttgaaaaatgattttattgtttttgttttttgttataggatttttagagtaattaaatttaatagtggaaatgatatttgttgtagagtgaggttgtgtagttttttggttatttattgatggttgttaaagttttttttggttttttttttgtggtagatttttagttatgttttttttgatggttttattgatttgggagaagtattattggaatttattgttttttggtagtagtagtttttagtttttgttatggtagtaggtagtagggataggtggggttgggtggggattgtggtggattagggaggaggtttttgtgttattgttgttgagtgattagttttggttgttattagtgtttgaatagaagatttgttggaagtttttaaattttgttgtttgttttattagttaatattattttaagatatgttgttagttaggtgaggtagtttatgtttgtaattttagtattgtgggaggttgaggtgggtggattgtttgagtttaggagtttaagattagtttgggtaatatagtgaaattttatttttataaaaaatataaaaattagtgggtgtggtggtgtttgtttgtggttttagttattttggaggttgaggtgggaggattttttgggaggtggaggttgtagtgagttagtatggggttaatgttttttagtaaaaaaaaaaaagagagagagagatatggtgtttttgaatggtttttttttttggaggttttttataattaatttattagtgaagatatgtatttttttattatatatgtttattgagagttttattaggaaaatagaaattaatttatgtatattaaatattaaaggttttaatataaaggattgaagattgagggaaataatgttagggaagttatttgttatagtttaggagtttgtttttttaaattttatattgaaatttttttttaaagttggaggtggggtttaatgggaagtgttgggttatgggagtggattttttatgtgtagatgaatgttttaggtgggggtaggtagggagtgagtttttattatattagtttatttggtttttttaaaatttttatttttatttgtttttttgttatgtgatatttgtgtggtttttttttgtttttttttatgagtggaagtagattgaggtttttattagatgtttagtattttagtttgtagaattatgagttaaattaattttttttttttataaattatttagttttaggtatttttttatagtaatataaatgaattaagatattattattaataattttagttagtagtattgaagtagggtttttttaagatgttatttggaaatttagtttgggtaatatggtaagattttgtttttattaaaaatataaaaaattagttgggtgtggtggtatgtgtttgtggttttagttattagggaggttgaggtgggaggattatttgagtttaggagttaggggttgtagtgagttaagattgtattattgtattttagtttgggtgatgaagtgagattttgttttgaaaaaaaaaaaaagttatttggaagttgtttttaaatttatagttatttaattatttgtttattattgttttttgaaataaatggtttttttttttaaaatttattaagggttttttattagttgatttattttggaagtataagtgggaggtgttttttgggaaatgtattttttggtttttttttggtaatagagattttagtaggtggtaatagtaatgttaagttgatataaattagtttagtttttaaggattttggtgatggtttatttaaaatattaaaagataagatttttatataaaggataaaggttatgtgataagagatgtatttttttttttttgatataattttttttatagttttgttttaggttatgggtggttaggtgttgtgtttgtaggagttgttaggtttgggtatgtattttgagttttggaaaagtttgttttggttttgtgattatttttttttttttgggaagggtgggttttttatattaatattgtggtttttgggtatggttttgtgaggttttggataatgtggataagtttttagtaagggataagaatgaaagtataagatgttttgtagtattttgattttttttttttattttggagaatttatatgtgtttgttattttgttatatttttattagtaaatatagaaaggttgtttttatgttttaaataagaaatttttaggggaatgtttttattgttagttatttgagttataaaaaaaagttattttatttttttttgagaagtagatatattagaggggtatttatggaattggattagtgtgtttatttttttattttttaaaagaaagatatattattagtagagatttgagaaattaggatagataatggttgattagaatttaatattatttttgggtaaaaataaaatgaaagttattgaaaaattttttaaattgatatttgttttttggtttttaatgttttattttatttttattaaaaaaaaaaatttaaatagttaattatttaattttttttaatttttagttaataataataaaaaagggatagtagttgatttttaggatttagggaatattaggtaattagtaaagattttggatatttgttattaataatttttgtaaaatttatattatttgggttattattgagggaggggtttttgtagttatattgtgttgtggtggagggggaaataggaagagatatagaatttgtgtttgagtgttattgtttaatgggatttgagttttagaggtttggtaggtttgatgaaggatagggtttttgttgtttagagttatattttaagagaagttattaatatttttgagatattatggtttattaataattttttttttttttgatagaagaaagttatgggttttgatagtagatatatttaagtttaaatttaagttttatttttttttaagttgtggggttttagggaagttgtttgattatttaagtttagtttttatatttgtaagatagaaagaaaatttattttatagggttgttgggaggatttagtgggataatttatgtaaagtatattagtatttgggttttagtaggtttttataagtttaaatgttttttaaggtattgtattttttattttttttttttttagatttttttttttaggttatagatataataggttttttaaatatattgttttttttgtttattgtattggaaaatgataatttttaagaatttttaagatttttaagaatttaggagaataggttaaggtttttgtggggagtggtggagggaataaaaggaattagtgttttttgaagaaatggttgattttagatttggggttagaaatatttaagatggtttggaatattttattagtttagaaagtaaggaagttattaaagatagttgattgttaaatgaattagtagttaattggaaaaggttttttgttaaagatggaataatttgagtattaaaaggataataaataatttgtagttatgaaatttaagtgtgtataatgatattaaaataattaaataaattttattagttatttttggtagatgttaggggaattaatttattattttaaatattggtaaataaagggaaagaattaatgttgtttatattttggggtaattaaagtagtttttgaaaagtttgtttttatagaagtagtttagttgataaataaataaagatagaattattattattattagtattttattataatttgtaatttttaataaaataataaaataaaaaggttgttagtattatgaaaggagagatagtaattatatattatgtattttttgagggaaatatatagtattatttatgaagtgttttttttttattatttgattattattgaatttaaattttataaagtttttagaattaattatagatttataggaaatataaggaagaataggttaaatgatattatgatgttgatattagtaaaatttagattatggataagtttataggaaaaataatttaattttgattataggtagttaattgttttttaagaatattattaatattttgatatataaatttttagtttttttttatgtatttatattataaaaatgggattattttaatattgttttgtgatttttttgttaaattaataaatagtagatagttatttatatttataatataggtataatttatttttttaaataattttgtagtattttatagtgtggatatattataattaataaagttaatttatttttgtatagttgtatttttaaaggattattttttaaatttttgtattaagaaaagaatttttagtgaatgttggtggtatggtgatggagttttgatgaggaataagatattggtgtaatttgagaatatttttttataaaatgttaattaattataatttgatttggagaatttaatgtagaaaattttggtagatattaatttatttaggggatggaggttaatattatgtgatttttttgttgtgttgtagtgagatgaataaggaataattttatgtggttttgttgtttagaatgtttgtttaagtttggttatggggaagtattagatagaattatttttattttatagaatataagtttggttaagaattgttaggaagatgaaagataagaaaagattaaggaattgttttaaatgaaggtattttaaaaagagatatgataattgtatgtgatatgattttttggataggattttgggtttgagggggggaaaaagttatagtaggatagttagtaaaatttgaatgggatgtaaaagttgtttgaattaaaatggagttatttgtgttaaaaaattttgataaatggtgttggggaaggttatgtataagtgtttgataataagaattattataaaagatgttttgtattagtttatttttatattgttatgaataaatatttgagattgtgtaatttataaagaaaaagaggtttaatggatttatagttttatatggttggggaggttttataattatggtagaaggtgaaggaggagtaaaggtatgttttatatgagtgaaggtaagagagtgtgtgtaggagaattgttttttataaaattattagattttattagatttatttattattatgagaatagtaagggaaaaatttgtttttatgatttaatattttttattaggttttttttatgatatgtggggattatgggagttataatttaaggtgagatttgggtggggatgtagataaattatattatgttataaaaattataattttatataaaggttattgtaattttatatatatatataaatttgtttagtaattgtttgtttaattttagattggtattatttttgttaatgattttttagttaaggataattattttaaaattattgtgtaattttttttattttttttttaaaaatttttgtttttttttatttttttgaatatgtatatagtttataatggtatatgtatttttattgtagtgtttattatttttttttagagagtttttttttgttatttaggttgataagtatttgtgggttagaggttagtgttgtatagaaattgatttttaggttgtgggggttatatgttggttatgtaggagagtgtttttgttttgaagatatatatatagaagtgttttgtggtaatgaaatatttttttgtggtaatatttatattattatgtttgtgatttgttttttaaatatttagaaaaagtttagagagtgggtaatggagtaaatatagtgaaatattaatagtttgggaattgggtaggtatgtgggagttttttatatatatttggaggtaatttgataaggtttttgaggttttgtattttagtttggtttatgatttgtttattttttgtaatagtttgtgtttgggtttgagtgatatgtttttttaatattttaaatttatttagttgttgtttatagagtttttgaatttggtagggggatgattaaatgtatagaaatatggtgagattatttattattatttagttttatttagttttattttaggattagggtttttagtgaagtatagaatagttagagaattattttaattatttggtttgaattattagatttgaaaattgagatttatagaggggaatggtttaaaggtttttatagtaaggttagtaatagatttgagtttggttatttgttttttggttttataataaagagagttgttatttaaatagtgaaatattaaatataagttagtatattttttgtggtgttatttagatttatgtttaaggaaggatttgttttttagttatagggaatgttgttagtagatagtttttttatagtttatttaagttgttgaaaaggagttatttgagattatgttttttttgtagtatttatattttgtgattgagagaggtaggggtataaagatttggttattttgatttaaagagagaaattttgataggtaatattttttttagagtaatatgttgtatttgttaaggtttgttgggtttttattatagtttagttttttttgtggtttatttttttttttatttttttttttttataggtgttgatagttaataaatatttgtagtttaaattttgttatagtatttgtgtttagagagtttatttggatgtttaatatattttttaagattaattattgattgattatttaattagttaaatttttgatttatattttttggtttagattttttgaggtaagaagtagagagtttattggtataggtaatatgaaagatagtttgtattagttaggtatggtggtgtgtatttgtagttttagttatttggtaggtaagagaattgtttgagtttaggagtgtaagattagtttgggtaatatagtgagattttgttttttttttttttttttttttttttttttttttttttgagatagagttttgtttttgttgtttaggttggagtgtaatggtatggttttggtttattgaaatttttgttttttgggtttaagtgatttttttgttttagtttttgaagtagttgggattataggtgtttgttatgatgtttagttaattttttgtatattttttagtagagatggggttttattatgttggttaggttggttttgaatttttgattttagatgatttatttattttagttttttaaagtgttgggattgtagttatgagttattgtgtttagttttattttttttttttatttatttattttttagaattggagttttgttttgtggtttagtttggagtatagtggtgtaattatagtttatttttgtttgttatttttggggttaagggatttttttgttttagtttttaagtagttgggattataggtatatattattatatttagttaatttttaaatttttttgtagagatggggttttaaatttttggatttaagtaatttttttattttagttttttaaagtgttgggattataggtataagttattatgtttagttaattttattttttttaaagaaaaaaaaaaatagtttatgtaggaagatagtgttttttattgtatttttaaagttggtgggattgtaaagatttatttagttatttttttaataaagatttattgtgtatttaggtgtggtggtaggtatttgtaattttagttatttggtaggttgaggtgggagaattatttgaatttaggaggtagagattatagtgagttgagattgtgttattgtattgtagtttgggtaataggagtaaaattttattttaaaaaaaaaagatttattgtgtaattattatttatatttggggaaatgaattagatatggtttttgtttttaaagagtttatagtttagtaggaggggtttggtaaggatataaataggtgaaattaatttttaaaagtgttataatagtatatgaatgaggatatatggaaggttaagaagaagtaattaaatttttttggagttaggaaatgttttttaggagatagtggtttgggatagttttttaaatataaagtattatgttttgtgttatgtgttttattatttgggtttgttgataatttttgattttaatttttggatgtaggaattagtatttagtttaaataataagattaattattatttattgagggtttattatgttgtaaatgtttaatattgtaaatgttttattgtattgatttatttaatttttaaaataattaatttatggggtgaatattattattatttgtattttatagataaggaaattgaggtttatagaagtaaatattatttaaggttttatagatggtatgtgtaggagttaggatttgaatttagggtgtatggttttagagtatttgtttttaattattagattatgagatatttttataggtgggtttggggaagattagttgttaatggggttatttgagggaaaaatttaggtaatgtagatatttatatggaatagtgattattgttttttttagggagaatgaatttgagttttgtatagatggttatatggtagtgatatttagagatgagtgaggaaaagtaaagaatagatgatgaaaaaggaaagagggagaggaatataggtataagaatagtaatattgttgggtgtagtgttttatgtttgtaattttagtattttgggaggttgaggtgggtggattatgaggttaggagtttaagattagtttggttaatatagtgaaattttgtttttattaaaaatataaaaaattagtttggtgtggtggtgtgtgtttgtaattttagttatttgggaggttgaggtaggagaattatatgaatttgggaggtaggggttgtagtgagttgagattgtgttattgtattttagtttaggtaatagtgtaagattttgttttaaaaaaaaaaaaaaaaaaaaagttagtaatattatagaagtggaataatagatgtttgttttttttaaagtttttttttttgtaattataaaattaatttgtgtatattgtaaaatttagataatatagaaatgtgtaaagaaaaagttaaatgttttataagaatattgttaatattttgttgtgaaagtttttagttttttttttatgtatatatattataaaaaattaaattattttaatattgttttatggtttttttgttaaattaataaatggtgggttaggtgtagtggtatatttttgtaattttagtattttgggatgttgaggtgggtagattatttgaggttaggagttggagattagtttggttaatatggtgaaattttatttttattaaaaatataaaaattagttaggtatggtggtgtatgtttgtaattttagttatttaggaggttgaggtaggagaattgtttgaatttaggagatggaagttgtagtgagttaagattgtggtattgtattttagattgggtaatagagtgagattttgttttaaaaaaataaataaataaataaatggtagttgtgtttgtttataatgtaggtataatttattttttttaataattttgtagtattttatagtgtgaatatattataatttataaagttaatttatttttgtatagttgtatttttttttttttttttttttttgaaatggagttttgttttgttgtttaggttggagtgtagtggtgtagttttggtttattgtaatttttgttttttgggtttatgtaatttttttgttttagttttttgagtatttgggattatagttatatattattatgtttggttaatttttggtatttttagtatagatagggttttattatgttggttagattggatttaaatttttgattttgtgatttgtttgttttggttttttaaagtgttgggattataggtgtgagttattatgtttggttgtatagttgtatttttataggggattattttttaaatttttttgtattttgaaatttttgtaattttaaaattttaaatgtttaaattaaattttagtttttaaattaagatttttataatgtgggttaggtatagtggtttatatttgtaatattggtatttggagaggttgaggtggaaggattaattgaggttagaaatttgagattagtttgggtaatatagtgggattttattttataatttttaaaaaataaaaatttaggttagatgtggtggtttatgtttgtaattttaatattttgggaggttaaggtgggtagattatgaggttaggagattgagattattttggttaatatagtgaaattttgtttttattaaaaatataaaaaaattagttaggtgtggtggtaggtgttagttatttagaaggttgaggtaggagaatggtatgaatgtgggaggtggagtttgtagtgagttgagattgtgttatgtattttagtttgggtgatagagtgagattttattttaaataaataaataaataaataaataagttgggtatattggtgtatatttgtggttttagttattttagatgttgaggagggaggattagttgagtttttgatgttaaggttgtagtgagttgtgattatattattgtattttagtttgggtaatagagttagattttgttaaaaaaaaaaatttgtaatatgtattattttttttttttaaaaaaagggattattatttgttaatttagattttggtatagtggttatttatgggatagatattgagaagatagaatttagtgaattgggtgattggttatggggtttataggtttataatgttttatatattttggtttatgtgaatgatagggatgtgagtttgaagtttaagggtaaggtttggttgggtaggttgaagttttagtagagtgaatgtggtgatttatgaattatagagtataggattttagttaggggttttggttgtattttaagaagtttataatttgtggaggtggtgagattggttttgtaagtattttatatattgtataggtatttattttgttaatgtttatttattttagttaggttgaaagttatagaggataggttgtgtgtgtgagtgtgggtgtgtttgaatattggtgtttttatttattgttgaatttttattgtttagaatagagtatgatatttagtagatatttaataaatgtgttaagtgaaggaatgattgaagttaatgatgtgggatgtatgttatttaaggggtaggtagaggatagaatagaaaggagaagaagaagatttgagaggtaggaagtatattggggtaaaggattgggtatgggaggagtgtttataagtttaagggagtttttagtagtgtggttagtagaggttgatttagtatagaggttgtgagttagttggttttttttttgtatagatgaggaagtagagttgttgttttagaggttagatatgttttttaaaatttgtgtatgaatggtttagttaagattgtggtttgtgatataaaggtattttaaagttgggtgatttttggttttattttttttatggaataattatttagtggtttgttgtagttgtttattgatatatgtaatatataatgtatgtgtttagagaaatatagataggtgttatagatatatgttgtatgttgtgtggtatgtgtggtatttgtgtatgtgtgtgtatggatagagtgtttttttattagaatgttgggtttattttggtatgatgggttgttttttaattgtagttttagattttggaatagtgtttggtatttggtaggtgttgatgtgtgttgagtgttgagattttggtattgtttgtagatgtgatgttattgttatgttatttgttgtagttggtttatgaattttttgtggtgtttatttttgttgttgtgggttttgattaagtttgtgtttattttgttgttgatgattttggttgagtataagttgtggaagatgttggtgagtaagtgtgagatattttgggtgtgtagtgaggaggggtgtagatgaagtagttgaggtttgggatgttgtgttagtgtaagttgtgtgaggtggtggggttgggttgtgaagttgtagtggaaggttttagagtaggtgagggaggaatataaggaggatttttaggtgggttggttggggttgttggatttggttggtggtgaagttggtgtttatattgttttttggtatttgttggtttgggatgttaaagatttttgtgttttggagtttttggtttttatggtaattgagatgttgttaattttttgtggtattttggtttttggttttattttttttgttttgttttttttttggattttgttattgttgtggttattgtaaatatttgtgtttttagtattgtttttttaaaagtgagtttattaagtgtgaggatttatgaagaaaggtttaattgatatagttaggtttatttgtaaaattttgtatttaattatttatttttatttattttttaatttgttaagtaattgtttatttatttattatatttattgtgtaaagattgtgttttaggtttgtgttgattgttgaagatattaaagaagtatgatgttgtttttgtttttaggaagtgtatagttgtgtatgtgtgtgtttgtgatgatggtggtgggtgtggaggtaaaagtaaaataattgtattttagtgggttaaggttaaggtggagataaatattggttgttatggaattataaaggaggataggaatttagtttgtagaaggagtgattattttttggaataaatgaaaattaagtagagattttaaagaaggagtagattgaatattattagttattaaagaagtggaaattaaaattataatgtagtattatagttagtagaatgataaaaaataaaaaagtatttaaataagagtgtgtgtgtggtggtttatatttgtaattttaatattttgggaggttgaggtatgaggattatttgaagttaggagtttgagattagtttgggtaatatagggagattttatttttataaaatatttaaaaatgtgggaaggatggaatgaaatttaggaggagtggaatttaaagagtgtgagggtggaggaatgatattgataggttagggttagattataagtgggttggtaggttataatagggaatttggattttattttgagggtagtaggaggtttattaagggttttaagttggggtatgttatggttagttttgttttattaagattattttgattgttatgagaatagataggagaggtaagaggtattaggaagtttagttaggaaattagtatagaagttaggaaagagatgaagggagattggatgagagagagggaattggattggagatagatttaaaaagtagaattgataagatttgttggtggataatgggaggtaagaaataggtattaagaatgatttttaggtattttgtgtgtgtaattaggggggtgatgatagtattattgagatggaaaagaggattgtatttgtttagggtagtagtataatattatattgattgttgttatttgtatattatggtttttgtttataggtgatataattaattattttttattttatattgagtttgtttgttttatattttgaaatttatttttagagatgagtgttagtatgtttgtttatatatttgggttatttttatttttattttttttggttgggtttggtttttttttttgttttttttaggattttttttgttttgagagttgagaagttagggttgtttgttttggattgtgtgtttgagaggtttatttttggttgttttttgtatttttttttatagagtaagagattatagggttaagatgatgtgttttgtgttttgtttttaggtatatgggattttaaaagtatgtgtttatatgttttgagtttattttagggtttatgtaggttttttttttaagtttatttttttagggttgatttaaaagggtagttatggtggggggaggaggagggaagtggagggagttttggtaaataggtatttttttaattttttataagtatgtaaggtttttagtggtgtaggaaggagttgtgggtaggaagaggggtgtaatagtttgggggtttttattgttttaatgtggtaaatggagttttagttgggtggttttgttatttaggagtagttttgtttgtggaggttttttggtttttttttttgttatagggaaggataggataatggatttttg

SEQ ID NO: 238 - DNA, 22709 bp, Artificial Sequence
  Chemically-Treated DNA
ttttttgtttatggagaggtttttggtgaatgttagatagtaattaaataattaaaaggtttagagagtgttgtgagtaggagaagatgtgggtagtttggttggtttaggagagatgagtggttagagaatgaaaggaaaattgatgttttttaattgggttgtttaataatgggagattaagtgggtttaggagaaatgtggtggggggggggggagttttttttaaaaaattggggttttttttttttgttttatatatggaaatttagttttgattttaaataaatattagatttaagaaggtgaggattttaaagaagatttaaatgtgagattaggaagatttatgtttttattattttttttaatatattttattaatttttttatagggatagtgttttaaaatatgatgatttttatatattaaggtgaagttgaatattgttgttgtttttttattgtatgaaaggaattttttagaatttatttttagggatggttttttttattttgaatttttgtatttgtagggaattttatggggtagaggagtgaagagggaataatgtttttaatttaaataaaattttaaattaagtttttagttttattggtgggatagtttgtgggggaatttatttttttttttggtagtattgttttgggggtgagtagagagtggatttggagttttttttttttgtttgatttttgtttgtttgagtagtatttttgggttagtggttgtagttatttgggtgttgttaggggatgtagtggtttaaaggattgagtgggtggtgtaggttggaatttgtggggtggattaattgtggtttggttatagttttgtttgttgattggtttttttaggttttgtttttgtttgttttgttttttttgttggggtgttttggagttgtgtgttttttgttttggggtgtttattgtgtagagtgtggtttggagatttgtgagttggggaaggttgttgtggagttttgattagaggttggggttggggttggtgtagattgagggttggtttttttgattgtgggagaaatgttgggagttggagtaagtagggttttgggtggggtgaaaggaaaagttgggtttttagagtgaagattgagttttttttgtttgtttatattgagtgtatttggggaatgagttagagttagtttttttttttttttttttttttttattttttattgttgttatttaagttaaaagtatatattgattataaatattaggtttggaaagggtagttgtaatagttgaagtgtgtttattttgggggtttgagagtgtagaaggtttgggaaagaggtgataatgataataaaattgatgtggatgttttagttaaaggtattttttttttatttgatgatttatttttttaggaagttggtttgagaggtaaattttaaaatattttgatatgaaatattttgtttttttgattaatttaatgtgtatgtttttttatattgatgtgtttttttaaatattttgtattagattttaataatgatttatgtgtgtttattttttaaaagtttgaaaaagaaaattttgtttattgaaatgaattttatgaatggggtaggttggttgtattgggatggaattgtttatttgatttgaatgaattggtaggagttgtggttatatttaaagggttagagtgtgtgtttttttttgtttgtttttaagttttgtgggttttgtttattttgtttgttgtttttttgttggtggttgttttttgtggtgtttttttttggttagtggaggggtgggaggaggggtgggggtgtgtggggtggggggagaagttttggagtgggtttgggttgtagtttttttgtgttggggattttgttttttatttgttagtgttaggttttttttttttggtgtggatgatattagaatttttttaagttgtgttgtgttatagttgtttgtgaatattgagttgtttggtgttgttttgatatttttagaaagaatgtattttttgtaaaaaaaaaaaaaaaatattgagagagggagagagagagagaagaagagagagagatggagggagagtgagatagagtgagtaatgtaatttgattgagtaggttgtatgttgttgttttttttttttttttgttttttgttatttaggttggtattggtgattttttttttttttaagtttgattttttgtttttaattatttgggaggatttaaattaattttaaaaatttaattttttttttttggaggttttttaggggttgagaggatggttttgggattggtgtttttgagggagggatttgttttttaagttgtaatagttagttttgggatttgttttttaagttgtttagttagttttggtttttgtgagttgggttgtagggatgtttttgagagttttgtgggttttgtggttgtgtttttgtgtttttgtgtgggttttgggtgtgttgggtgggtgggtggtgtgaggggaggttgtgttattttagtaatttaggggtttatttaggttttttatttttttttttgtaggtgatttgaggagggattttgtttttgagtggttgaggattttggtgtagaggagtttggtttgtagaattgtagagttgttgtttttttttataatttggttttgttttattttgttgtatttagtttttggatttttgtttttttttttttttttttgttaaatgatttttttaagataatttttaaaaaatttttttttttgtttatttttgttttttagtttttttatttttttattgaaagtaaattatttaatgatttttgattttttgatggtaggagttttttgattttttaggtggattgttttttttttttgtgtgtgggttttgggtttggtgagagggtgtgagtatagttgaggttatggaggtgatggtggattagttgtgttgggtgagttattattattttgttgtgtttaatgggtagtatttggatatgtattatttgggttttagttatttttatatggatgtggtgtagtatttgttgttggaggaggtggatgtgttttttaatattgatggttaaggtaattatgttttgttttattatggaaatttggttagggttatggtgtagaggtattttttgatttattatggtgagtgtgtttggggtgttggggtttttgttggttgttttagttgttttggtttggggaggttgggagggatttgagggtggggagaggttaagtgaaagtttttatttgttgtttttggtttatttataaaaaaattggggtttggaaatgggtgaggaaggtttttggtttgttgtgagagtgtgttttgaaagagttgtagtaggtgttttttttggttggtggttttggggtttggtgtttatttggtgggtgttaggttgtagttttttgtttttgtgtggttgtaggttttggggtggggggttttgggatgtttttaagtgtggggtgttttggttttgtttttgtgggtttgggttttttgggtttggtagttggtgttggataagtatggttggaatttggtttttttaaaaaatttggtgttttttgttatttgttagttttttttaggtgggtgggtggggtggagggggttttttgttagtgttttttaatttgtatatttttagaaaggttttagagatttatttatttatatttttttttttgatttttttttagagttagtgtttttggtttttagataggttttttattttttggttttaggaatggaattttgatgttgaaggggtttgggggggaagatttttgttttaagtttgagggatttgagattttttagatttttggttgtatagaatttttttgtgtttttgtttttaagttgtttttttgtttgtaatttttgttttattttgtttttgggtattgttttttattagttttttatttaagatgtaggatatatttttgtttaaataaaggtaattttagtattattttttttttttttttatttggagaagtttaggagagttttgaaatgtaaaaaaagaagattaggtttgtgtagtttgaggaaaaaagattgaatattttttagttttaagtttgtttttaaagaagaaataggggtaaaatattgggtagaaaaagtgtggggttttttgagtttagttagattgaattttgttttgatttttttatttagagtttgttttgatatggatgatatagtttttttggtagtaggtgttttttattttgttgttgttaggttttaaataattgtttttgtggatggggtgttttttgtttatgttttgtgtggattagtagttaggtggaaatgtggtagaggtagatttaatattatttattatattattttttgtataatatgaattttgatttttggtgtttagagaattttttttttttttttatttttttttttttttttttttttaagattttagttttagtattgtttttaatggttgaattgaatgttaaatgttgaggtaggtattggttttaaagattaagaagtgtgtggatttgtatttgttttttaaatgtattttttagagtgtatgagttatagttattttaagattgtgtgttttaaatgaaggttaattagattttgtgtttgagttattttttatttaaaatatatatattaattggaattttgtgttttaggggtttaggtgaaaatttatttatggtattggtgggattatagttttattgagggtgtatggggtttatgttattttttttttttttaggatttgggagggtgagaaaagtagagaaaatggttattttagggtttagttttgggaattttttttaatagtttgagtaatgaaaatgtttttgtaaattttattttaggttttttgtgggtagtttggttgtttttgagtaagtattgggttaggtttttggaaattaattttgaaagttttttgatttttgttttaaggttttttttttttgtatttggtgttgggagttgggtttgattttagggttgttttttggtgtggagtagttgtgtggttgggttttattttttaggtttttttatttatagttggtttttttattaggttggttgggattaagtttgagttagggaatttagggttattgaaggaaatttataaattaagttaggttttagagagagattttggggaatgtgatttaggtggtgtatttggagaggttaaataagtaaaggggtttttttttttttttgtagtaattttttgggtgttagttataggttttttattttgttatatttgatgggatatttttgtgggagagatgggtgaaggattttgtttttagtttgatttttaggtgtgttaggtaggtattttggggattgttaggatgagagagtgggtttgagtttgggtttttgttgaaaaggaggttgatgtgaggtagagattttttaggtgtttttgatggttttttagggttatatttatttttttttttttttttgttttttttttgttgttttatagggagttaggtgtgttgtttgtttttgttttatggatttttattttggttggatggtggtaaagttttgggtagttattatattgtttttttttggaattttagttttttttttaagatgtttatttattatggttttttggggtttttttttgtttattttttggttttgtttttttttttgttggggggttatgttagtttgtatttttttatttttttgtttattttgttgaaggatgtttttttggatttattgttgtttattttaggtttggttggtttggtttggtaggatgagaaagagtgttttaagtattaggtgtttttgtttgatagtatgaagttggagttgttttatttttgtggtagtatgattgttttgggtggagtttttttgttgatttattattttattattatttatttgttttatgtgtttgagtatagttttggattttttttttttagtagtttgttgggtggtttttttattggttttggatgtaagtttaggtttaaggtttggtttagtataggtaggagttagtttttttttggagttttttttttttttttttttttttttttttaatttagggttgtatttagagggattttttaggggagttggggtgttttaaagtttgttgagatgttattttttttattttttttgttgggaaggtattgtatgtttttttattttagtttatgtttggttttggaagtagaggggaagtgggatttgatttaaaattttttaatgagttgggataggaaaaaagataaataaaaataaagttatgtttttttttgtttgttgtaggatttttggattgggttggtaatttttagttagtttttaagattaaatggaaggttgagggaataatttttgagtgttttatgttaaaatgaaatttttttaagtttaaataaatataggtttttttatgatttttttggtttttgttattttgattgttttttttgtttagtttaaaggggattatgtagtgaggatagttttttattagatgtgtagatataaagtgtgtgtgtatgagtttggttaaagttgtatgtatattttttgtgtggaaaagggggtttttagttgaattgggagaaagtggtggttttgtattggggaagtagagttgaatgaaaattaaatgttgtttggtttagttagttatttgtagtgttttttagagtttttagtgtagttaggggtaggaaattgtattaggatatattgtttggttgagttgtagttagaggaggtagaaaggaatggaaaagtgttttaggtgtgtattttagttttttgtgttttgtttttttttaaaatgtaaatgttgtttagtagtatgttgtatttttatttagttggtgttattatttgtatgaagaaaaattttatataaaatattttggttttaaaaataaattgatttattattaattttatttttaaataaagtaattgagttaaaagagagttagggattttttgatattgatttaattgtattattagatagggtttggtgaagattttgatgtttttttaggtgtgtttattttagagtgggtattttttttttgattggttttaggtattttgtttttgttgtttttttatagattttatatagaaagtaattgtgaaaattatttgttttttagggatgagatgagtagttttgaaattgagtttttaaagttttggtttgaaaaattttagagggagtattttgggagtttagtgattatgagattagtttttagggtttttttttagggtgatatttattttgattgtttgagtaggattgtttttatttagttgatatgttttagttaatttaattatttttagattgttgtatgtgatagttgtattgtttattttgagttaggaattttaatagagtttggatgtggttaggttgatagaagaatttagatttgtatgtttagtatatgaaagtaggtaggagggagagggaggtaggttagttggtggagttaaaaagaaagtaagaggttgggagagttggaggtataaagtggttatggtgtttggtaggggttgggtttgggggtggagggaaggattaagaagtggggtgtagtttgatttagaaatataggttggggagttgaattgaaagagagtagatttatgtattttgaggttgtgatgggatttttttttttttttttttttttttaaagtttttttttttggtaaggttatgaggttggggagagtttgtggtatttgaggttggtgtagtggtttgtgtggggggaggggatagagtgatttttttaagatattttggtttttttatttttatttttgtgtttgattttttttttttttgtgtatattttttgttttaagtttagttttttttttttttttatttttttttataagattttgaatatggaggggagaaagagagggttgtggtttttttaagttagagttaggaatattgatatattgattttggtttttttggtgaggaggagaggaggttattttaatttggtttttttatttttttttttttaattttttttttatagttgtgaaaattgagaatagtatatttggtaggggtggtgagtgagttgggatttttgggagtgtggaggggaagttttgagaagtttttttttttgtagggggtggaggtggtgggaattttttaggaggggatttttttggttttagtggttgtttttttttttttttttttttttttttttatttttttaattttttttttgtaaatgtatttgttgaaggaggatatagagaagagagagtttttggggttgttgttggaaatggttgaagttgtggttagggtatttattgttgttttaatgtttgggtttttggggttgggatgaagtttttgtaaataaaagatagagtttttgtgtttagggttgttttttagttttattgttatttttttagttgggtatttttttttattgttatttgattgagtttttgttttgttttttatttttttttatagtttggtttaagggttttaggttaaggtggagtaagaggtatttgttagtagttgttgaatgttaagaggttttgttgttttgtggtttttgttatttaagagagaggtgtttgtttgagtagtttataataggtaggggtgaggagaggggaggaaagaaggtaggagagagttagggtttttattaggaaaattggttgtttgttgaagtgatagattagaggtagtaaggaaaaaagaagaagaaaagtttataggaggtaatggtaattttgttgagtgaattaagatagaaaattattttagtgtgtagaattttgttgaagaggtaattgttgttagtttttaaggtgtttttgaaaaggaagttattattttttttattattttgtaaatgagaggaaattagattgattatgttaggttgggaggttttttagtattagggtgtttaggagttgggtggtaattatgttttttgtttttaattatagtggtttttttttatattgttttttgtttagtgtttaagtaggggaggagtttgagggggttttttgtttgggtagggtggggagtgggtttgtagttttagttgggatagggttagtgttgttttagaaggggttgatttagtagttattagtgatataaaaaggtaggtttgtggtttggtttgggttgtagttggttatttgtttatttattttttattttttttttttagttttttttatatttagtttgttatattttttaggtttttgattttaattgaaaggtgtttgggtgtgatttaggtttgagttttttttaagaattgagaagagttgttgggtatttaggaaggtgtttttggtatgtattgtagtgtgtttgtgtttaattttaggggttttggggtatagtaaaggttttttggggattttaggttaagaattttttggaatgtggagtaaaaaaaaaaattttttttatatttttattttttttttttttttaaaaaataaagtagataaaaattagtgggtattatttttgatttttaagggtgtaagatttttttttatttgtaaaagtttttaatttttttgaagaatttatttttggagagtattataggtttttaagtgtgaatttttttagtttttttttatttgatttggggttttttaaaggtttaataggttttatatttgttaaggtagattttttttttttttaggggaattaaaatttttaagtattttattgggttttttttttttattttagtggtttgggtaggttggaggttattaattatttttttaaaataaaatagtttttagagtttattttttttttttatttattttttggggtttttttttgggttttttttttttgggggattaatttgagttaagttttttgtttttgtaaggaaggggagttttggttttttttgggtatttagagaattgggtgttagagatttgtgtgtttttgggttttttaaaattaaggagatttttttagaaagtattttttttttttttttgtaaagttgaaattagttagttaatttttttatgttttgaaatggtaatttaagggatttttttaaggagttttttgggtgggtttgggttgttttttagtttgggttgagggagtgaatgttgtttagattttttattggtttggttggttttttgtttattttgtttgtttgtgtttttgggaaaagagaaattgtaggtaggttttggttattgagtagttattttgttttgttaatttgtttttttttttgatttttttttgattggttttattttgtttttttaaatttttttttttttttttttttttttttttttttttttaggttttttgtttaaagtttgtattttttttttgtattttttggttggggttatattttaattttagtttttgtaatagtggttggaaagttatggaaatttttgttgggttttaattgttttttttttagttagggatatttgtagtttgattggaagtaaaatttaaaattttagttagtgaaattaattagttgattgattaatttatgtatttatttattatttgtttatttatttagttattgatgaatttttttttttttttattttaatttttattatttaattaatttttatagatagatttatgatgataatgggttatttttgttttttttttttttttttgagggaaatgaatggaatgtttgttttttgttattatttagggtttaggatttttttagggaagtatttgtagttggaatttgtatttttttttggttttgtttgattttttttattaagttgggtaagttaagaatagggttttgttgtaatgatgtatttgttttttttgtgggtgtttttgtgtgtgttgggggaatggttatgttaggatagtattttttagtttaattttggagtattttggaaagaggtgggggtggatatgttttttaaaagaggagggagaaggaaaaaagttttttattttatgttttttttttagttttaaatgttgttagtttttttgtgtgttttttttttttaagtggtttatttgtgtttttgtttttagaaggtagggagtgtgtgaattgtggggtaattttgattttattgtggtggtgagatggtatgggatattatttgtgtaatgtttgtgggttttattataaaatgaatggatagaattggttttttattaagtttaagtgaaggttggtaagtttttgggaagggatggattttatgttgattattttgggttttttatttttttttttttggaaggatagttttttgtaggaaattgataggatagtttttaattgtgttagttggtttgggatagtttttttttttttttttttttttttttttttttttttttttttttttttttttttttttttaaatttgatatatagaatagttttttttttttttttttttttatttatgttttttaagttgtttgtgaatattttaaggagattgaatttttggttattaaatttgtagtgtatttttgaatagaataatggtatgaataggattagagtagttggtttaagtgtattgatgagtattgtttgatagatagagatatttagtatgaggatggaatgttttagaaattatttagaatgggtttttgaagttgtggtgtgtggttttttaggaaggattatagatttagtgtaatggatggatttgttatgttaatgttttaaaatggttggagttgattaaatgaattttagaggttttattagtaattagtgagtttaatgttatttttttttttttttggttttagtatttgagaattttttataggtaatttttatgggaaatgttgtgtgagtttttttatatttggtatttggtttttttttttttttgaattattattagtaaggtgatagttttttttttttttttttattatttttttaaaaattttttaagtatgagggatttttgagaaaatttggttttgttaagtatttataaggaagataatttataggggatatttatttgtaagtttttttttggaagtttgaatagtgaatgtatgtgatagataaataataattttagttatagttaagagattaaaatgttttatgtggtgttgatatttattaagttgagatgggaggaggggaatttttttatgtagattaatggataaattagtatttattaatttttaaggaaggaaaaagaatatttttgtattttttttaaagaatattttgttttttttattagattgtagtgtaatttaatattttttatattttattttgaagaaggaaaaattttttttttttttttttttttttttttgagatagagttttattttgttatttaggttggagtgtagtggtatgattttggtttattgtaatttttattttttgggtttaagtaatttttttgttttagttttttgaatagttgggagtagggatatttgtttttatatttggtaaatttttgtatttttagtagagatagggttttgtttttttggttaggttggttttaaatttttgattttaggtgatttattgttttggttttttagagtgttgggattataggtatgagttattgtttttagttaaagaaggaaaattttttagggatggaaatgtttatatgattttaatttttgataattttggatattgaggttttattttttttgatttttgtttttttttttaatttttttaatttttttttattttttttttagtagtttggtttttttttttttttttttttttttttttttttttatgtgtaaagttgattttttaggaaaaagttgttggatatttgagtattggagataatttataaataataatttagtttttttaatttaaatattaagatgtttgaatgtattagaataagaagtgtttgaaaaaaaaaaaaaaaaaaggttagaggtgttagtgtagaatgaatatgattatattataaaagaatgttttgaattatttaaaaatttggttttagtaaaaaaaaaaaaaaaaaaagagagagagagagagaggaaaaaaaaataataaataaaaatttttttgttaaaatgtgttttggtattattatagttgttttttttgttttttttgttttttttttaataaaagtaaagaaggaaaaagagggattaaaagttttaaggtatgggttgattggtgagtaaaagtttatttgatatttttttgggttttttttttttgtttggttagattgtagaggaggattgtaattttattttatgtaattttatttttatttattttttataggaaatttttagaattttgagtaataattgttttgaattttagagtttaatgattgttatatttttatttgtttttttttttttaattatttgtttttggtggtttgatgtttttagttttatagaatttataagttatagggaggtagaatataggatatatttagattttttttttttttttttttttttttttttttttttttagttttgagatgtatttgatttttgaatatttagaattttttgttttttttttttttgtattttttgattttttattttagttttagtttgttatttttgtttgatatatttgtagatttattgaagattatttagtttatatatagttagtttttttgtgagatgtgtatttaattttgaaaaaattaatgtaagaaataggagagatgattgaagggaagatttatagatttttttttttttggtattgttaggatttttatatattttattattagtgagaggttgagttgtttgttttaatatattgtattttttgttagtgatttaaatagtgtggttttgagagattttaagtttttataaagtttgtagtattggaagtatttttttttgtttttatttagattgttgttaatagattgtaaaagattatatgttgtattttgttatttggagttttgattttattagttggtattatatgtttgtattttgtatatttagaattgttgggttaggaaatttaggtgtttgagtgatattaatttgttatatttgagtagtttttttaaaaaaaaaaaatattataggaagataataattatatataatttaattgttaaaattattaagtattggttttatgtagtatttttttttaaaaagtatataaatgaaatagttgtttaagtattaaattattatattttataaaggtagttgggtagaggtatatggggttagattagtatttatggataatgtgaattatatttaagatggatagtaaaagatttttatttttttttttatgataggttagggtagtttttagtttttagttttttagaatatagaaaagaaagaatttttttaaaaaggttatatatattttgttatttatattttatagaagtatatttgtgaaataatttagtaattttgaaagaaaaagggttatttaggttaatttaaaattgttattgggttttttatatttggtagttttgggtgttggttttaattttttgtttgataaaatattgatataaaattgtattagaattttaggttgggtgtggtggtttatttttgtaattttagtattttgggaggttaaggtgggtagattatgaggttaggagatagagattattttggttaatataggtgaaattttgtttttattaaaaatataaaaaattagttggggtggtggtgggtgtttgtagttttagttatttgggaggttgaggtaggagaatggtgtgaatttaggaggtggagtttgtagtgagttgagattgtgttattgtattttagtttgggtgatagagtgagattttgttttagaaataaaagaaaatataataaaataaaaaataaaaaataaaaaataaaattgtattaggatttttatagtttttgttttgtgtttttataattatattagaattttttttattatagatagagattaaattttttttttttttattttttttttgataatatttttgatttaggaatggggataattttgtagttaaaattttttttttatgatggaaggtgaggaggagagagaggtttatattagaagtgatttaattttatttttttttaatggttttttttagttttatttttttaaagtgtgaatagagaatagttatttgattaatttaaatatgttaaaaagtgaaagaaaaattttttttttaaaggaaatgagggtagtaatataattaaggaattaaaatttaggttgaggttgatttttgatttgtaattatgttattttatgaatagtaagtaggaaatggttgattttatgaaggtggattggtattagaggaggtgagggatttagggtttttgatgagtggtaatattttttggttttttgagtttgtttgattggtgaattaaatttaggtgatagttagttaaagagagtgagggtggttgttttgtgaatgggaagtgattaagtttgaaagtatagattgtggtggtttatgtttgtaatattggtattttgggaggttgaggtaggtggattatttgaggttaggagtttaagattagtttggttaatatagtaaaattttgtttttattaaaaatagaaaaattagttgggtatggtggtaggtgtttataaattttagttatttgggagtgtgaggtaggagaattgttttaagttgtgaggtggaggttgtagtgagttgagattgtattattgtattttagtttgggtgatagagtgagattttattttaaaatgagaaaaaaagaaagtgtaggttgtataaatttaggaggttttgttgatttaggatgttttatttggtgtttttttaggtgtgttatttatgtgtatgtgttatatatttgtatagatattttttgtagaatttgttgttgtgttggtatattgttttttttataatttagtatttttttatttgtgatttagagtgtttttggtgtttggttttgtgttttttttgttgtgaatgtattttgatggttggagtttgtttgaggatggatatttttgggagttgtgtttgaaaataattttttgtggttttggatttggtgaaaaaggtaattgaaagtttagttttaaaatgaggttggttaatttaaaattgttatttataaaaattaattttttggtgtattttgtgggttgagggtaggaggttaagattgttagggaggaggttttggttttttgtttttattggggagtagtaggtgaaattttgattatgttattgtaattttgatatgttttagtggagtggtgatatttttttttttgaggtagtttttggggatttgtattatttttatgtggattatttgttagttttgattttaatgataattttttttttttttttttttttttttaagtttgtttttatagtgatgataatatatttaatatttgttttgattttatttttttttttttttttatttttagtttgtagttaggagagtagggatgttttgtgtgaattgttagattattataattatattttggaggaggaatgttaatggggattttgtttgtaatgtttgtgggttttattataagttttataatgtaagtggattgggattagtaagaatagggtttgttttttgatggtgattagtaaatagtgttattattattttttttaagtgaattgtttattatgggggtagatgataggttttaaataattgatgtaataggatttagtttggaaaattattttgtttagtatagttgtgttgaggttgagggggtttatagtttggtagttatataatttttttggtatgtattggatattttatatattatgtagtaatttgatgtgttgagtgggtttgtgtggtttataaggaaaaaaaaaaaattttttttttggaaaataaaaaaagttattggttttattttgttgtttttttatattttaaattttttgtagaaagagagaatgaaagagaaaggtaaatagaattgtaatgtgtggtagggggtttggaaattaagaggatttatttggttattgagaggtaaaaagttttggttaaatttgtgttataaatttgaaatggattttttgtataaaagatatggaaaaaaatgtttgatagattttgtttgatgtttttgtttgaattaatttttatgtgtagagagttagtttttgaggaaggtggttggtttgggggatgttattatattagggaaaataaattgttattttttttttttatattatgttagtagagtggtaattgttagttatttgaatttagttgtgttatttttgatttttttatttggggtttttttattttgtaatatattttaattttaaaaaattttttttttagtttttttttttttttgaaattattttggtttagaggttatgattttagtgaggttttaagtttatattaattttaaagataaaaatggttattttggtttttttttgtgttgtttttttttttttttttttttagttttttttgatttttttaaatttttttggttaatttgattttggtaaagtttggggttgaatagggaggagatagggatttttgtttgtggtggttttggtaatgaatttattttatttaggaatatttgggaattggggaggaagtttttttggttggattttttgagttataaagaattttttagggtgattttagtattttgttttttttttattttttgggagtaagttgttgtgattttgaggagttttgtatgtttattttttgtttgtgttaatttttttgttgtggttttggtgtagtgaatgaaattagagttttattatgattttttatttttttttaggttttgggattgtggtttatatatatttattagtaatttaatttaagttttatttttattttggggaatttgtttgttgattatagtagagatagagatttgtgattaaaatttggaaggtttgggtttataagttattaggttattagtattagggtttattagttatttagttattagtattgtttatgaaattatttttgggttgtaatttatggattttaaagaatttttatgttatttgattatatttgagtttgagatagttttatgatgtagatagggtagaaattatttttattttagttttatttgagggagttatgatttagaaaagtaagttgtttgtataaggtaatgtggttgagaaagtataagagttagggtttattttagagttaggaggtttttttgggaagttggtagtgttagaattaagaggagaattaggggaaagggaatgttttttttttttagagtataataaaattgtaataaattgtgtgtgtgtatattttatttttatatttgtggaagtataggaattataggagattaattagttatatgtttttttgaatagttagttgggatgagatatgattttatttgtgtttgattatatatatatatatttttgaagaatatgaattttttaaattaaagtaaagttgaggaattttttttatggtttatttttatttttttaattttaatgagtttggtttttatggttgggttttagtgaatgggagatagaaatttttttatttttaagagtggtttttttgttttttttggtttattaggaatttgtaaaaggaggtgattgatgtgtattgaataataagagataataatttattaatattgttattatgttgtgttttgttttgtttttttagatatttttatatggatgttataagttttttttttttatttaggtgttgagataattgtttattttggtattagtattttttagtggtgttgtgattggttatttggggttgtgtggttattggtgtaattagatattatatttagatatttggttatgtatagttagatattggtattagagttgtgtatttggatattattttggtgaagatttgatgtgggagtagatttttgttatttttgtaggttgtatttttattttgatgataattttgaagaaggaatttggagatgtttttttggtagtgatttttttgggtttttttgttattggttatgttgtttttttgggtttggggaaaataaggttttagttttagtgtggggttttgtttttttttttaggtgattttttttagtttagttttgggaagttgggtgttggttgtttttagtaggttggttatttgaatttttttttttttagttgtgattttttggttttgggaatagataggtaaaatttagagttaagggttttttatttttgagaattgtggtggaaggtgatgtttttagtttgggaagttaggaatggttaggatattgatatttattttttgagtttgtttgttatttttttttgggaatatggttagatgtggagtttgtttttttgggtagatgtttgttgttggggttaatttgtttttgtttttttgtggggagtaatttttgtttattttgtaaagtttttttttttgattttgggtttttaaagtaaatgtatttttaaaggtaaatgaggtttattaagaagagagaaatggtagatgtttttgagattgaagttttttgattttgagagtagggtttggtttttgtttttttattttagtatatttttggttttttttttttaagatgagtgtttttttgtgttttgtattttataggtggttattaaatatatgttgattggttggttggttgtttgtttggttagaagtggagagttagagttaggtggaaatagtatttgtaattattgtagttgttgttggaatgatataggtaagagattatttttgggttaggtgtggtggtttatgtttgtaattttagtattttgggaggttgaggtgggtagattataatgttgggagtttgagattagtttgtttaatatggtgaaattttgtttttattaaaaatataaaaattagttaggtgtggtggtaggtgtttttagttttagttatttaggaggttgaggtaggagaattgtttgaatttgggaggtagaggttgtagtgagttgagattgtgttattgtattttagtttgggtgatagtgggagattttgttttaaaaaaaaaaaaaaaaaaaaaaaaaagattatttttaagaaaggtatggttttataaaatataatttggttatatataaattttagtggaagattttatggtattttttaaaggttaggtagaagagaggtaattgaaagttatttagtagaatagtatagtttttatttttttaaggtagatagttttaattatttagaggttgatggtttggggagtattttttaagttttgaagtagatttgttaaagtagttaaaatggtattttttttttgaagattttttattattttgatttttatgaaatagtttaaggaagttttaaagaaataagataagtgaattttatttttgttattagagaaatataattgtattagatggggttgtaatttggtaattgtatgtattttagttttttagtttttgggaaggagataggagaaggtgggagggaggaaggggttagttgaaatggaaatagatttttgatttggggtggttagtggaattttttttggtgtgtgagagtttgtgtattttagaggtagtaaaaaagtaaaaaaaaaaaaaaaaaattgatttttgtttagattaatagatttttgattatgaagaaggaaggtatttagattagaaattgaaaaatgtttagtaaatttaaaaagtgtaaaaaagtgtatgatttattggaggatttttttaagaatagtttgtttaatttggttgttttttttagatatatgttttttttgagttatattttgttttttagttattttagttatatgttgattatgtttatgttgatgtatttgttatttagtttgttttttggattatattatttttttagtatggttattgttatgggttagagttttgtttgatgtttatagggtttttagtgagagtttttgtagttttttttgatttgtatttttgtaggagtagtattatgaagtttaaatgtgatggatatatgtttttgaaggtagaaagtaaaattatgtttgttattttgtaaaggagtttattgtggtgtttgtgttttaattattgaatttggattttatttgtgaataagttattttgatttatattttttatttaatagggtttttagtgttgtgaaaaaaaaaatgttgaatattgtatataatttatattgtaagaaatattgtataatgattttattgtatttgggtagttgtaaggtatgaaggatgttaagaagtttaaggaatatgggagaaatagtgtggaaattaagaagaaattaggtttgatatttaaatggataaattgttagttttgtttttttttattggttatagttgtttgatgtattaaaagaaaataaaaaaaagaaaaaagagaaaagaaaaaaaaagaaaaaagttgtaggtgaattatttgtttaaagttgttggtttttgtaaaggaaatattagttttgggtaattagtgttattgtttattagttgttgttgagggttttagagagtttttttttaggtttatatgttttgtgaataagtttttgtaattgttgtttgtatgtataatttaaagtattaaaataagaaaagatgtagatttattttattatattatatagattgaattgttgtataaatttatttattgttagttttaagaattgtttttttttgtttgtttgttttaatatttttttttttttttaatttttggttgaataaattagattatatttagttggtttaaggtggttgtgtttggagggttttttgttttttttttattttgtttttggatgatatttattaaatagtttttaagagtttggtggtatttgttttgtttttatttttgtagtttgtgttgagggtagtagtgtatgagttattagtgtgtatgttagtgattttggtttgataggttatgttttgtaattggtttggttgtttttttgttttgttgtgttttgtgttagtgattattgtttttaatatagtttgttggaataatattataagtataataataaagtgaaaatattttaaaattataaaatgatattgtatttatgtggtggttgagtttttttagaatttggtagttttagttaattttagagaaaggagttaaaagaaataatttaataattagatatgttaagttatttattaggaattgatgttaattttagagagttaatgtttattttggggggagttgggaatatttggagttttatatgtgatttggagg

SEQ ID NO: 239 - DNA, 22709 bp, Artificial Sequence
  Chemically-Treated DNA
tttttaggttgtatgtagaattttaaatatttttagttttttttaaaatagatgttgattttttggggttagtattggtttttagtgaataatttaatatgtttggttgttaagttgttttttttaatttttttttttgaaattagttagagttattagattttagaagagtttggttattatgtggatatgatgttattttgtagttttaaaatatttttattttattattatgtttataatattattttaatagattgtattaaaggtagtgattattaatatagaatatgatagggtgaagaggtagttgggttgattgtaggatgtggtttgttgggttagggttgttgatatgtatgttggtagtttatatattgttatttttagtataggttgtaggaatagggataagatagatgttgttggatttttagaagttatttaataaatattatttaaaaataaaatggaaaagaaataagaaattttttgagtataattattttaggttaattgaatgtaatttagtttatttaattaaaaattgagagagaaggaaaatattgaaataaataaatgaaagaaagtagtttttaagattagtagtaaataaatttatataatagtttggtttgtataatatgatgaaataaatttatatttttttttattttggtgttttgaattatatatataaataataattatagggatttgtttataaagtatgtaggtttagaaaaaggttttttgaaatttttaatggtaattggtgaatggtaatattgattgtttagaattggtattttttttgtagaggttaatagttttgaataaatgatttgtttataattttttttttttttttttttttttttttttttttttttttatttttttttaatgtattaaataattgtggttagtgaaaggaaataaaattggtagtttgtttatttgaatattagatttagtttttttttaatttttatattattttttttatattttttaaattttttggtattttttatgttttatagttatttagatgtaataaagttattgtatagtattttttataatataagttatatgtaatgtttagtatttttttttttatagtattagagattttgttaaataggggatatgagttagaatggtttatttatagatggggtttagatttagtggttggaatatagatattatagtgagtttttttgtaaagtggtaaatataattttgttttttgtttttaaaaatatatatttattgtgtttaggttttatgatattgtttttgtaaaaatgtaagttgaaagggattgtagggatttttgttgggggttttgtgagtattgagtagggttttaatttatggtggtgattatgttggaggggtggtgtggtttaaaggataggttggatggtgggtgtattggtgtgggtgtggttagtatgtggttggagtggttgaagggtgagatgtggtttagggaggatatgtgtttggagagggtggttgggttaaatgagttgtttttggggaagttttttagtgagttatgtatttttttgtattttttggatttgttagatattttttggtttttggtttggatgttttttttttttatagttaggggtttgttaatttaaataaagattaattttttttttttttttttatttttttgttgtttttgaaatgtataggtttttgtatattaagaagggttttattgattgttttggattagggatttgtttttattttagttggttttttttttttttttatttttttttgttttttttttagggattgaagaattaaaatatatatagttattagattatagttttgtttagtatgattgtatttttttggtaatgaaaatagaatttatttgttttatttttttagaatttttttagattattttataagaattgaggtagtgaagaatttttaggagggaaatgttattttggttattttgataaatttgttttagaatttgaaaagtattttttaggttattagtttttaggtggttaaggttgtttgttttgaagaaatgaggattgtattgttttattgagtaatttttggttgttttttttttatttggtttttaagaggtgttataaaattttttgttagaatttatatgtagttgggttgtattttatgaaattatgttttttttaaaggtgattttttttttttttttttttttttttttgagatgaagttttttgttgttgtttaggttggagtgtagtggtgtgattttggtttattgtaatttttgttttttgggtttaagtaatttttttgttttagttttttgagtagttgggattagaggtgtttgttattatatttggttaatttttgtatttttagtagagatggggttttattatattgggtaggttggttttgaatttttgatattgtgatttgtttattttggttttttaaagtgttggaattgtaggtatgagttattgtgtttggtttaaaagtgattttttgtttgtgttattttaatagtagttgtaatggttgtaagtgttatttttatttagttttgattttttatttttaattagataaatagttaattaattaattaatatgtatttaataattatttatggggtgtaaagtataaaagggtatttattttgaaaaggaaagattaagaatgtgttagagtaaagagatagagattagattttatttttaagattaagagattttagttttggagatatttgttatttttttttttttaataaattttatttgtttttaaaaatatatttgttttgggggtttagaattaagaaaggaaattttataaagtaaatagaagttattttttatagggaggtagaagtagattaattttaatagtagatatttgtttggaagagtaaattttatatttggttatgtttttaggggagggtggtaaatagatttaaggagtgaatgttagtgttttggttatttttgattttttgggttgaaagtattgttttttgttatagtttttaagggtggagaatttttggttttgggttttatttgtttgtttttaaagttagaaaattatagttaagaaaggaagaatttaaatggttaatttgttgagagtagttaatatttagttttttgaagttgagttgggagaggttatttggagaaggaaataaagttttatattggagttgagattttattttttttaagtttaggaaggtaatgtgattgatggtaggagagtttagaaaggttattgttagaggaatatttttaggttttttttttaaagttattattaagataaagatgtagtttatagagatgataggaatttatttttatattaaatttttattaagataatgtttagatatatagttttgatgttgatatttagttatatatagttaggtatttaaatataatatttagttatattagtagttatataattttagataattagttataatattattgagagatgttgatattgaggtaggtagttattttaatatttagataagaagaaagagtttatggtatttatgtagagatgtttggaagggtagagtaaaatgtaatgtgatgataatgttaatagattattattttttattgtttaatatatattaattgtttttttttataaatttttggtaaattagagaagatagaaaaattatttttgaggatgaggaagtttttgttttttatttattggagtttagttatgaagattaagtttattaagattgaggaggtagaagtgagttatggagaggattttttagttttattttgatttgagaaatttatgttttttagaaatatatatatatgtgattagatataagtgagattatattttattttagttaattatttaaaaaaatatatagttagttaattttttataatttttatatttttatgaatatagggatgaaatatatatatatataatttgttataattttgttatattttaaaaaaagagagtatttttttttttttggttttttttttagttttgatattgttaattttttaggaaagttttttgattttgaaatgggttttgatttttatatttttttagttatgttattttgtgtaagtgatttgtttttttgagttataatttttttaagtaaaattgaaataaaaataatttttgttttgtttatattatgggattattttaggtttaaatgtaattaagtaatatgaaagttttttgaaatttataaattatagtttaaaaataattttataggtagtgttgatgattggatagttaataaattttaatgttaataatttaatagtttataagtttaagttttttagattttaattatgaatttttatttttattgtagttagtaagtaaattttttaaagtgaaaatagaatttggattgaattgttgataaatgtatatagattatagttttaggatttaagggagaataagggattgtagtaagattttagttttatttattgtattagggttatagtgagagagttggtataggtagggaatgagtgtatagggttttttggaattatagtaatttgtttttaagaagtgaaaaagaagtagggtgttggggttattttgagaagttttttatgatttaaaaaatttaattagaaaagttttttttttaatttttaggtatttttgagtaagatgagtttattgttagaattgttgtaagtaaaagtttttgttttttttttgtttagttttggattttgttaaagttaggttggttaagagaatttaggagaattagaaagagttaaaaaggaaggagagagagagtaatatagagaaagattaaaataattatttttgtttttagagttaatgtaaatttgaagttttattagaattatggtttttgagttagaatgattttaggaaaaaaaaaaaattgaaaaaaaaattttttaagattaagatatgttataaaatgagaggattttaaatggaaagattagaaatgatataattaaatttaggtgattggtaattattgttttgttaatatgatataaaaggagaaaatgatagtttattttttttggtatggtaatattttttaggttagttattttttttaggagttagttttttatatgtgaaagttggtttggataaagatattagatgaaatttgttagatatttttttttatgttttttatatagaggatttattttaaatttgtagtatagatttagttaagattttttattttttagtaattaaatgggtttttttagtttttagattttttgttatatattataattttatttattttttttttttattttttttttttgtaaagagtttaaaatgtaaggaaataataaaataggattggtggttttttttgttttttaaaaggaagattttttttttttttttataaattatataggtttatttagtatattggattgttgtatggtatgtggagtgtttaatgtatattaagggggttgtgtggttgttaggttgtgagtttttttggttttagtatggttatgttagataaagtagttttttaagttaggttttattgtattaattatttggaatttgttatttgtttttatggtgagtgatttatttggagagggtggtggtgatgttgtttgttggttattattaggaagtgagttttgtttttgttgattttagtttatttatattgtgaagtttgtagtagagtttataggtattgtagatagggtttttattggtattttttttttagagtgtggttgtggtggtttgatagtttgtataggatgtttttgtttttttggttgtagattgagagtggggagagaggagagggtgaaattaaaataaatgttaaatgtgttgttattattatgaagataggtttgaaaaaaaaaaaaaggaaggaagaaattattattgaaattaaaattagtaagtggtttatatgaaagtaatatagatttttaaaagttgttttgagaagaaaaatgttgttattttattggagtatgttaggattgtagtaatgtggttagagttttatttgttgttttttggtaggagtaggaagttggggttttttttttggtagttttagttttttatttttaatttataaagtatattagagggttaatttttatgggtggtaattttgaattagttagttttattttggaattgggtttttagttgttttttttattaagtttagggttataagaggttgtttttaaatataatttttaagaatatttatttttaaataggttttagttattaggatgtatttatagtaaaggaggtgtaaagttaagtattaaaaatattttggattgtaaataaagaaatgttgagttataaagagaatagtgtgttaatataatagtaaattttgtaaagaatgtttgtgtaagtgtgtggtatatatatatgggtgatatatttgaggaagtgttaagtaggatattttaggttaataagattttttaaatttatatagtttgtatttttttttttttttgttttgagatggagttttgttttgttatttaggttggagtgtagtggtgtgattttagtttattgtaatttttattttatggtttgaagtaatttttttgttttatatttttgagtagttgggatttataagtatttgttattatgtttggttaatttttttatttttagtagagatagggttttattatgttggttaggttggttttgaatttttgattttaagtgatttatttgttttggttttttaaagtgttggtattataggtgtgagttattatagtttgtgtttttaagtttggttattttttatttataagatagttatttttattttttttagttggttgttatttaaatttgatttattaattaaataaatttaaaagattaaggaatgttgttatttattaggaattttggattttttgttttttttgatgttagtttatttttatgaaattagttattttttatttgttgtttatggagtagtatagttgtaggttaaaggttagttttaatttgaattttgattttttggttgtgttattgtttttattttttttaaaagagagattttttttttattttttgatatatttaaattgattaggtgattattttttgtttatgttttaaaaaaataaaattgaaaaaaattattggaagaaaatggagttgggttatttttaatgtaaattttttttttttttttattttttattataaaaagaaaattttaattgtaaaattatttttatttttggattaaaaatattattaaaggaaaggtaagagaagaaagagtttagtttttgtttgtgatgaagaaaattttggtatggttataagaatatagaataagaattatagggattttggtatagttttgttttttgttttttgttttttgttttgttatgtttttttttgtttttgagatggagttttgttttgttgtttaggttggagtgtagtggtgtgattttggtttattgtaagttttgttttttgggtttatattatttttttgttttagttttttaagtagttgggattataggtgtttgttattgttttagttaattttttgtatttttagtagagatggggttttatttgtgttagttaggatggtttttattttttgattttatgatttatttgttttggttttttaaagtgttgggattataggagtgagttattgtatttggtttgggattttggtatagttttatattaatattttattaagtaaaaagttgaagttaatatttgaagttgttagatatggagaatttagtgataattttgaattaatttgagtgatttttttttttttaaagttgttaaattgttttatagatatgtttttgtgggatgtaaataatagagtatatatgatttttttaaaaaaatttttttttttttgtgttttaaggaattggaaattaaaaattgttttggtttattataagggagaagatgggagttttttgttgtttattttgaatgtaatttatattgtttatgagtgttgatttaattttatatgtttttgtttgattgtttttatgaaatatggtaatttaatgtttaaataattgttttatttgtgtattttttgggagaaagtattatgtaaaattagtgtttaatgattttgataattaaattatatgtgattattatttttttatagtgttttttttttttagaagagttatttagatatagtagattaatattatttaggtatttgggttttttagtttagtaattttgaatgtatagagtataagtatataatgttaattggtaaagttagagttttagatgataaggtatagtatgtaattttttgtagtttattgatagtaatttaaataaaagtaaaggaagatgtttttagtattataaattttatgggaatttagggttttttaaagttatattgtttgggttattagtaggaggtatagtatattaaagtaagtagtttagttttttattagtggtgagatgtatgaaaattttggtaatgttagggggaaaagaatttatgagttttttttttggttattttttttattttttgtattagtttttttagggttaaatatatattttatagaagagttagttatatatgggttgggtggtttttagtgaatttgtaaatgtattaaataaaaatagtaagttggaattggaataaagggttagggaatataggaaagaagaaaataaagggttttaggtgtttagaagttaaatatattttagggttaaaaaaaaaaaagaaagaaagaaagaaagaaaaagaaatttgagtgtgttttgtgttttatttttttgtagtttatgaattttatagaattaaaaatattaaattattaaagatagatgattaagaaagaaaagatagatgaaaatgtgatagttattgaattttaaaatttaaagtaattattatttagagttttagagattttttatgaaaggtgagtggagataaaattgtataaaatggaattatgatttttttttgtaatttgattagatagaggaagaagatttaagaaaatgttaaataaatttttgtttattaattagtttatgttttgagatttttaatttttttttttttttttttatttttattagaaaaaaaatagaaaaaataaaaaaaataattataatggtattaagatatattttaataagaaggtttttgtttgttgttttttttttttttttttttttttttttttttttttttttttttttattaaggttaggtttttgagtgatttaaaatatttttttgtggtgtgattatatttattttgtattaatatttttagtttttttttttttttttttttaaatattttttgttttgatatgtttaaatattttggtgtttaggttggggaagttgagttgttgtttatgagttatttttagtgtttagatatttggtagtttttttttaggaagttagttttgtatatgagagaaaggaaaaaaaaaaaaaaaaaaaaaaaaattaaattgttggaggagaggtgggggaaggttgagaaagttggagaagggggtaaagattagaaagaataaagttttgatatttaggattgttaaagattaaagttatgtggatatttttatttttagaaagttttttttttttggttgggagtggtggtttatgtttgtaattttagtattttgggaggttgaggtggtggattatttgaggttaggagtttgagattagtttggttaaaaaggtgaaattttgtttttattgaaaatataaaaatttgttgggtgtgggggtgggtgtttttatttttagttatttaggaggttgagataggagaattgtttgaatttgggaggtggaggttgtagtgagttgagattgtgttattgtattttagtttgggtgatagagtgagattttgttttaaaaaaaaaaaaaaaaaaaaaaagaaagtttttttttttttaaaataggatgtgaaaggtgttgagttgtattataatttgatggggagggtaaagtattttttaaaaagaatatagaggtgttttttttttttttttagaaattgatggatgttaatttatttattaatttgtgtggggaaatttttttttttttattttgatttggtgaatgttagtattatataaagtattttgattttttagttgtggttagagttgttatttgtttgttatatatatttattatttaaatttttaaagaggagtttgtaaatgaatgttttttataagttgttttttttataaatgtttgatagagttaggtttttttaaggattttttatgtttaaaaagtttttaaaagaataatgagagaggagagaaaaaattattattttattggtagtagtttaaagagaaaagaagattaaatgttaggtatgagaggatttatatgatgttttttataggaattgtttgtggaaagtttttaaatgttgagattaagaaaggaggaaagtggtattaggtttattggttgttggtgaagtttttgaaatttatttaattagttttaattattttgaagtattagtataataaatttatttattgtattgagtttgtaattttttttgggaagttatatgttataattttaggaatttattttggatggtttttggaatattttgtttttatattaaatgtttttatttgttaaatggtgtttattagtgtatttaaattagttgttttggttttgtttatattattattttatttaggaatatattgtagatttgataattaagaatttagtttttttaaaatgtttataagtgatttaagaaatatggatggggaaaaagaggggaaaagagttgttttgtgtattaaatttgaaaaaaaaaaaaaaaaagaagaagaagaaaagaaagaaagaaaaaggaaaaaaaaaaaaattgttttaagttagttgatatgattggaggttattttgttaattttttgtagaaagttgtttttttggaagagaggaaatgagaaatttagaatggttagtatggaatttatttttttttgagaatttattagtttttgtttgggtttaatgaggggttggttttgtttgtttattttgtgatagagtttgtaggtgttgtataggtagtgttttgtgttattttgttgttatagtggggttgaggttgttttatagtttatatattttttgttttttggaaataaaagtatagataagttatttagggaaggaaaatatgtaggaaagttgatagtatttggaattgggggagaaatgtaaaatggagaatttttttttttttttttttttttttggggagtgtgtttatttttatttttttttaagatgttttaaagttgagttggggaatgttgttttggtatgattgtttttttgatatatatggaggtgtttgtagaaggggtagatgtattgttgtaatagaattttgtttttggtttgtttgatttgatggagaagattgggtaggattaaggaggaatgtagattttagttataaatatttttttgagaaaattttgagttttggatggtggtaaaaggtaaatattttatttattttttttaaaggaaaaaaaggaagataaaggtgatttattattattatgggtttgtttatagagattgattaaataatgaagattaggatgggggaaaggaaggatttattaatggttagataggtgaatagataataaatagatgtatagattgattaattggttgattgattttattagttagggttttagattttatttttaattaaattgtaaatgtttttggttggaaaggaagtgattaggatttagtaggggtttttatagttttttagttgttgttatggagattgaagttaaagtatgattttagttagggggtgtaagggggaaatgtaaattttaggtagggaatttggaagagggggagggagggaaaaaggaaaagggaaggtttgggaggatagagtgaagttgattagaggaagattaggagaagaggtaagttaataaagtggggtggttgtttagtaattaaggtttgtttatagtttttttttttttaaaaatataaataaataaaataaatgaaaaattagttaggttggtaggaagtttgagtagtatttatttttttagtttaggttggaaagtgatttagatttatttagaaagttttttggaagaattttttaaattattattttaagatatgggggagttggttaattgattttaattttgtaagaggaagagaaagatgttttttaggagaatttttttggttttgggggatttagggatatatgggtttttagtgtttagttttttgggtgtttagagaaagttaggattttttttttttgtaggaataggaggtttaatttaagttggttttttagagaggggaggtttagaggaggattttggagggtaggtagggaagaaaaatgagttttgaagattgttttgttttaagagagtaattaatgatttttaatttgtttggattattggggtagaagaagagaatttagtagggtgtttgagaattttgatttttttaaaaggaggaaaaatttgttttggtagatatgggatttattgggtttttggaaagttttagattaagtaggagggaattaggggggtttatatttgggggtttgtgatattttttaggggtaagttttttaggaaagttaaagatttttgtaaatggaagagggttttgtatttttgaaagttagggatggtgtttattagtttttgtttattttgttttttaaaaaaaaaaaaaaaatgaggatgtaagagaggtttttttttttgttttatattttaaaagatttttagtttagggtttttagagagtttttgttgtgttttagaatttttgagattaaatataaatatgttgtagtgtatgttaaaggtgtttttttaagtatttaatggttttttttagtttttgaaaaaggtttaggtttgaattatatttagatattttttagttggggttaaaagtttgagggatgtggtagattggatgtgggggaggttggaaggaaagagtgaagggtgagtgggtgagtaattggttgtagtttaagttaggttgtaggtttgtttttttgtgttgttggtggttgttgggttagttttttttggggtagtattggttttgttttagttaggattgtaggtttattttttattttgtttagataggggatttttttgggttttttttttatttgggtattgggtagagggtagtgtgaggagaggttgttgtggttggaggtggggagtgtggttgttatttggtttttgggtattttggtgttgggggattttttagtttgatatgattagtttgatttttttttatttgtagggtggtggggagggtgatagttttttttttagaaatattttgaaagttagtaatggttatttttttaataaggttttgtatattagggtaattttttgttttgatttatttggtaaggttgttattgttttttatgggttttttttttttttttttttttgttgtttttggtttgttattttagtaaatagttagtttttttaatggaggttttgatttttttttgttttttttttttttttttttttatttttgtttgttgtgagttgtttaggtagatattttttttttaggtgataagaattatagagtggtgaggttttttgatatttaatagttgttggtaaatgttttttgttttgttttggtttgaaatttttaaattaggttgtgggagggggtagggagtagggtaggagtttgattagatgatagtggagggagatgtttaattggaaaggtggtagtggagttaagaagtggttttggatataaagattttgttttttgtttgtaaaagttttgttttagttttgaaagtttaggtgttaagatagtaataggtgttttaattatgattttaattgtttttagtgataattttaaaaatttttttttttttgtgtttttttttagtaaatgtatttgtaaagaagaggttaaaggggtaaaaaagagagagagagagagagagagagtaattattaaaattaagagaatttttttttgaagaatttttattatttttattttttgtaaaaggaggggttttttgaaattttttttttatatttttaaaagttttagtttgtttgttgtttttgttaggtgtgttgtttttggtttttatgattgtgagaaaggaattaagaaggaggaagtaaaaaggttaaattgaaatggtttttttttttttttgttaaaaaaattaaaattggtgtattggtatttttagttttggtttagggaaattatggtttttttttttttttttttatgtttagagttttatggaaagaaatgagaggaaagaaaagattaaatttaaggtagaaagtgtgtataagagggggagaaattaaatatggaaatgagggtaaagaaattagagtattttggaaaagttattttgttttttttttttgtataaattattatgttggttttagatattatgagttttttttaattttatagttttattagaaaagagaattttaaaaaaaaaagaaaaagaaaagaaattttattataattttaaaatgtataggtttgtttttttttgatttagttttttagtttgtgtttttgagttaagttgtattttattttttaatttttttttttatttttaagtttagtttttgttaggtattgtggttattttgtgtttttagtttttttggttttttgttttttttttgattttattagttagtttgttttttttttttttttgtttatttttatgtattgaatatgtaggtttgggtttttttgttagtttaattgtatttggattttattaaagtttttggtttaggataaataatgtaattgttgtgtgtagtagtttgaaaataattggattagttaaaatatattaattaaatagagatagttttgtttaggtagttggagtgaatgttattttggaaaaaaattttgaaaattgattttatggttattgggtttttagagtattttttttgaagttttttaaattggagttttgggagtttggttttaaggttgtttattttatttttaaaagataagtgatttttatgattgttttttatataggatttgtagagagatagtggaggtaagatatttggagttgattagagaagagatgtttattttgaaatggatatgtttaaggagatattaaaatttttattaaattttgtttaataatatagttaaattaatattagagaatttttagtttttttttgatttaattattttgtttagaaatggaattggtgatagattgatttatttttaaagttaaagtattttgtgtggggtttttttttatgtaagtaatgatattaattgaataaaaatgtagtgtgttgttaggtagtgtttgtattttggaaaggaatagagtataggaagttgagatatatatttggagtatttttttgtttttttttattttttttggttgtagtttagttaagtaatatgttttaatatggttttttgtttttgattgtattgagagttttaggagatgttgtaggtaattaattgggttaggtgatatttgatttttatttaattttgtttttttaatgtaaagttattgtttttttttagtttagttgagagtttttttttttatgtagagaatatgtgtgtagttttggttaggtttatgtatatatattttgtgtttatatgtttaataaaggattgtttttattgtgtggttttttttgagttgagtgagaggaatagttagaatgatagaggttaaaggggttatagagggatttgtgtttgtttaggtttgaggaggttttgttttagtatgaaatatttaagaattatttttttggttttttatttggttttggaaattgattaaaggttattagtttaatttagaagttttgtgataggtagaagagggtatgattttgtttttgtttgtttttttttttattttagtttattggggggttttaaattagattttattttttttttgtttttgaggttaggtgtgagttaggatgggaggatatgtagtgtttttttggtaggaagaatgggaagaatggtattttagtaggttttgggatattttggtttttttgaggggtttttttgggtgtggttttggattgaggaaaaggggaggagggaggagaaaaggttttagggaagagttggtttttatttgtgttggattgggttttgggtttggatttgtatttgaagttggtgggggagttgtttagtaggttgttgggggggaagagtttggagttgtatttgggtatgtagggtgggtaggtggtgatggggtggtgggttgatgaggaggttttatttagggtggttatgttgttatgggagtgggatgattttagttttatgttgttgggtaggggtatttggtatttgaggtatttttttttgttttgttgggttgagttggttgagtttggggtggatagtgatgggtttggggagatgttttttggtggggtgggtgggaaggtgaagaggtgtgggttggtgtggttttttgataaggaggaggatgaggttggggggtagatggagaggggttttggggagttgtggtggatggatgttttggagaaggggttgagattttagggggaggtggtgtggtggttgtttagggttttgttgttgtttagttagggtagggatttatgaagtagaggtgggtggtatatttggttttttgtggggtaatggggaaagggtaggagagagaaggagggtgagtgtggttttgggaggttgttagggatatttggggaatttttattttgtattggttttttttttagtaaaagtttgggtttaggtttatttttttattttggtggtttttggagtatttgtttggtatatttgggggttaggttggggatagaattttttatttattttttttatagggatgttttattaaatgtagtagaatgaagggtttgtggttgatatttgagaggttgttgtagagggggagaagggtttttttgtttatttggtttttttagatatattgtttaaattatattttttaaggtttttttttagaatttgatttgatttatgggttttttttaatggttttgagttttttgatttggatttaattttagttagtttgataagagagttggttgtgagtgaggaggtttgaaggatggagtttggttatataattgttttatattagaaaatgattttggagttaggtttagtttttagtattaaatataggaaggagaggttttgggatagaagttaggagatttttagggttagtttttggaaatttaatttagtgtttgtttagaaatggttaggttgtttgtaaaaggtttaaaatgggatttgtagggatgtttttattgtttgggttgttggagaaagtttttaaggttggattttgggatggttattttttttgttttttttatttttttaaattttaaaggagaaggagataatgtaagttttatgtatttttaataaagttatgattttattagtgttatgggtgaatttttatttgagtttttaagatataaaattttagttgatgtgtatattttaaatgaaagatgatttagatatagagtttgattagtttttatttaaaatgtataattttaaggtagttgtaatttatatattttgaggggtatatttaaaaagtaagtgtaaatttatatattttttgatttttaaagttagtatttgttttagtatttgatatttgatttaattattaagaataatattgaaattaaaattttaagggagaggaaggggaggggagtggagagggaaagagagttttttgaatattaagggttaagatttatattatgtaggaagtagtatagtaaataatattaagtttgtttttattgtatttttatttaattgttgatttgtatagaatgtgggtaaagagtgttttatttgtagaaatgattgtttaaaatttggtgatagtagggtagaggatgtttgttgttggaggggttatgttatttgtgttaaggtaggttttgagtaggggaattagggtagaatttggtttggttggatttagaaagttttatattttttttgtttgatgttttatttttgttttttttttaggaataaatttagagttggaaagtgtttgattttttttttttaaattatataggtttggttttttttttttatattttagaatttttttgaatttttttaggtgaaagggagaaagaggtggtattggaattgtttttatttaaatgggggtgtattttatattttaggtgggaggttaatggagggtagtatttagagatagagtaaggtaagagttgtaggtaaggaggtgatttgaaagtaaagatgtaagaaaattttgtgtagttgggaatttgggaaattttagattttttaaatttaagataggggtttttttttttaaatttttttagtattagaattttatttttgaagttaggaggtaagagatttgtttaaaaattaaaggtattagttttgggaaaaggttaaggagaagggtgtgaataaataggtttttggggtttttttgaaaatgtgtgaattgagggatgttggtagagggttttttttattttgtttatttgtttagaaagagttagtgggtaatagggaatgttaggttttttggaagagttgggttttagttgtgtttgtttggtgttggttattgggtttagagagtttggatttgtggaggtagagttagggtattttgtgtttggggatattttgagattttttattttaaaatttgtagttgtgtagagatggagggttgtggtttggtgtttgttaggtgagtgttaggttttagggttattagttgggagaggtgtttgttgtgatttttttaaaatatatttttgtgatgagttagaggttttttttgtttatttttgggttttaatttttttgtaaatgaattaggaatggtagatgggggtttttgtttgatttttttttgtttttaggttttttttgatttttttgagttgggatggttgaagtggttggtgggagttttggtattttgggtgtatttattgtggtgggttggagggtatttttgtattgtggttttgattgagtttttgtagtagggtgggatgtggttgttttgattgttgatgttaaaaagtatatttattttttttggtagtgggtattgtgttgtgtttatgtaggagtggttgaggtttgggtggtgtgtgtttgggtgttgtttgttgagtatggtggggtggtggtggtttatttagtgtggttggtttgttgttatttttatggttttggttgtgtttgtgtttttttgttgggtttggaatttgtgtgtggggagggagggtggtttgtttgggaggttggggggtttttgttgttggagggttgggggttgttgaatgatttgtttttggtggggggatgggaaggttgggaagtaaaggtgagtaaaggagaaggttttttaaaaattattttggaggggttgtttagtaaagagaagaaggggaagataaaaatttaaaaattgggtatggtagaataaaatgggattaggttgtaaaaaggggtgatgattttgtaattttgtgagttaggtttttttgtattggggtttttagttgtttggaggtggagtttttttttgggttatttgtaagggagagaatgggagatttggatgagtttttgagttgttggagtggtataatttttttttgtgttgtttgtttgtttagtgtatttgagatttgtatgggagtgtggggatatggttgtggagtttgtagggtttttggggatgtttttgtagtttggtttgtgggagttggggttggttgagtaatttggagggtaagttttagggttgattgttatgatttggagggtaagttttttttttggggatattggttttgggattgtttttttagtttttagaaaatttttaaaagaggagagttgagtttttaaaattgatttaggtttttttaagtggttgggggtaaaaaattaaatttaaaaaaaaaaaaagttattagtattaatttgggtagtgaagagtagagaggaggaggaggtggtggtgtatgatttgtttggttagattgtgttgtttgttttgttttgttttttttttgttttttttttttttttttttttttttttttttttttagtattttttttttttttttatagggaatgtattttttttgaaagtattaagatggtgttaggtagtttagtgtttgtagatagttgtggtgtgatgtaatttaaggaggttttagtgttatttgtgttgggggggaggagtttggtgttggtgagtaggggataggatttttggtataaggaaattgtaatttaaatttgttttaggatttttttttttgttttgtgtatttttgtttttttttttgtttttttattgattggaaaggggtgttgtagagggtggttgttggtggaggggtggtgggtagggtgggtgaggtttgtggggtttgggggtggatgggagggaatgtgtgttttggttttttaaatgtggttgtggtttttgttaatttatttgggttgggtggatgattttgttttggtgtagttagtttgttttatttatgaagtttattttgatgggtagaatttttttttttagatttttaaaaaataggtatgtatggattattattaggatttaatgtagggtgtttgggagagtgtattgatgtggggaaatgtgtgtgttaaattgattagaaaaataaaatgttttatgttaaggtattttgagatttgttttttgggttgattttttaagagggtgagttattggataaaggggagatgtttttgattggagtgtttgtgttaattttgttgttattgttattttttttttgagttttttgtgtttttaagtttttagagtgaatatgttttagttgttgtagttgttttttttagatttaatatttgtaattaatgtgtgtttttgatttgagtggtaatagtgagggatgagaaggggggaggggaggaagagattggttttaatttattttttgagtatgtttagtgtagatggatagaaagaatttggtttttattttagggatttaatttttttttttgttttgtttggagttttatttattttggtttttggtgttttttttatagttaaggaaattagtttttggtttgtattgattttaattttggtttttggttgggattttatggtgattttttttggtttgtgggtttttaggttatgttttgtgtaatgggtattttggggtggagggtatgtggttttgaggtgttttagtgagaggggtggggtgagtgggggtggggtttggagggattaattagtgggtgaggttgtggttgagttgtgattggtttgttttgtgggttttaatttgtattgtttgtttggttttttgagttattgtattttttagtggtgtttgggtggttgtagttgttggtttgaaaatgttgtttgggtgagtaggggttaggtgggaaaagaagattttaaatttattttttgtttgtttttagggtaatgttgttaggagagggagtgggtttttttgtaggttattttattgatggggttgagagtttaatttggggttttatttgaattggagatattgttttttttttgtttttttattttataaaattttttataaatgtaaaaatttgagatagaagaagttgtttttgaaagtaagttttgaaggattttttttatgtggtgaaggaataataataatatttaattttattttggtgtgtgagggttgttgtgttttaaaatattatttttgtagaaagattagtgaaatgtattggaagaagtagtggaaatgtgaatttttttggttttgtgtttggattttttttggagtttttatttttttaaatttgatgtttgtttgaaattagggttgaatttttatatataggatagaaagaaagaattttaattttttaaagaaagttttttttttttttgttatgttttttttgagtttatttggttttttgttattaggtggtttagttaagaggtattgattttttttttattttttgattatttgttttttttgggttagttaggttgtttgtatttttttttgtttatagtgttttttaaattttttaattatttagttgttgtttaatatttattggaaatttttttataaataaggag

SEQ ID NO: 240 - DNA, 5183 bp, Artificial Sequence
  Chemically-Treated DNA
gggggaagggatgtaagggtttattaaaaatattttattttaagggtggaatatattagaattttgtttgataatttaaaaagaaggaagaggagtggaataagggttttatttttataataattttatattggagttaattaaatgtgaattttttagtttttggtttattgatgtgaggaaagattgattgaagatagttttggtttttgaagggagttttgtttatatatatgttaatatttagttggaggtgaaaaggttagtatttgatttaggaagtatttatgtttgttttaaaaataaatttgttttataaatttttttattagtttttttttttattatgagttttgattataataaaggagttgttattaatttttatttaagaaaaggtttatttttttgaaaatatttattatttttttttttttttttttatgaaatgtgttaattttataggaattaataaattgtagtttagttaaatatatggatgtttaagtatatttgaaatttgagtatatttatttattatagatattttaagatttgtaaattttgttttggattatattattttaggattttagagttgtttatgattgtataggaaatggggaatattataggtttataaaggataattgatagaatttagtgtggtattttggggatattaaatattgtgtgatatgtaaaagattatttatgaataatataaaatatatatttattgtgttatttattatattaataattgagttgaaaatatattatatttagttaagataattgtggaaggaagaaattggtttgaataatatttttaggttttgaataatttagtataaattttaaatagagggtggtttgagaagaaaggggtagagattgggaaagatttagtataggaagttgggtttttgaagtttgtgttttgtagggttttttaattgtaagaataaattaaggttattttttgaggtatttgattgggtttaaatgagggaatttttttttttatttataaaattgtattagtttagagagtttgtttattttgttttagtaatttaaatatttttagaaaatttgtataaagataaattttttaggataaagtatttataattagtaaatttatatatatgaaaatgatttaaattaagggatgaattaattgtgtaaatatatagtgtattttttttttttgagtttttggatttgttttttgttatattttatttttaaggataagggaggggagagttgtatatatagttagataaaagatgagaagattttttttggtatgtttttgttggtaaagggaattattttttaaaaggttatttgaaaggaatagtaggttttgtgaatttttttaaaagtaggagggatgttaaggtttattagaaaatgtatgttggtatttaatttggatgaaggtgttaattttgtattaagtttttggtttagaattatttgtaaatatattattttggttaggagttttttagataggattagaaaggaagaaagagattgtaaatggaaagaaagataagttaagtatgtgttttgggtaagaagttttagtttaaggagatgtttgggttgttgtttggggttggagttgttttagtgggaggtagttagagtgtttgaggtagaagattttggggaaggaatgtagggtgaagagttggatttttttgaggattttttggtttttttgttgttttttggtggggtggttggagagatgggtaagagatttttttttttatgttttttttgttttatttggtggttttggaattagatttttatttgggttttgttgagttgtagggatgtagtgatttttattttgtgggtgtgtgttaggtatttgttgaagtggaattttttttttagttttgtgagttgtttggtagtgaagttggtgtgtattgtgttgggttgatttaggtagttgtattttttaattttttttggggtaaagtgggaagttatgagatggaaatgtaaaaatttttaaattgatttgagattttttatatgttttatggtaatatttaggtaaagaaaagattaagaatttagtataaattgggttgtggagggtgagtgatgaggtgtaaagtgttaatttgatgtaaattattagtatggttagattggtgattaatggagttttaagatattaatagaatattattgttataataattatttttatatattttttattttttaaatgtataaaatttttgaaaatatattaatttttgagatttttttgttttaatatttttgggtattttttttatgtattataatattagtttgatataaaagttttttaaaaaaaagattattattaatttttttggaaattaagtatattagttttttttagaataattaaggagtatttattaattagtaggattgatttgttttgggagggttttttttgatttttatttagttaaaagtttgtgttggagaagatgtttttgatgtgggggagtgataggttttttggtggttggtgtggagaggggataaggagttattatatgtagttagggttaggttttggtgtttttgtttatatgagtggtgaatgtattgaggtgagtttattgtgtttttagtataattttggtggtggtggtgatgttggattatgggagatgagagatttttagagtaaatagtgggagtgtattgggggtatttattatttatgtttgttttttgatttaatgtgtaggggttgtaaggtgtattgaagttttgtgagttatagtttggattataatttgagtgggagtaggatatttttaggtttttggaagtttggtaggtagttggttgggggtggtgatggtggtggtggtggtggtggtggggtgaattgatttgtatttttttgtttattaggaagtggttgttgttgttgtaattgttggtgttgattgtgtatgattggaaagttgtaattttatggtttgaggggtaggtttgggttgagtaggtttttgagttgttattgttaagtatggggtattttaggaaggagtttatttttgtattgtttatttgttattgagtgatttggttttgtgaagtttggtgtgattgtgttaatttttttattttttttatggggttggagaagaaaaatgatatgaatgtatagtgtgtaagagggggggtgggagggtggaggatgttggaggaggggtatgtgatggtgttagttaatggttgagttttttgtaaaagtttgttggtttttgtagtgatggattattgttttagtggtatttaaatttttggtgttttgttgtttaggtgatgtgtagttgtttttttaggtagtttaggtggtggtagttgttgtggtgattgtaaaggttgatttggagtgttggagtgaagaagagtaaaagttgtgttttgtgtgtgtttgattttgttgtttgttttgttaggtttttgggaggtgggggttgggaggtgttttttgtttttgttttttttttattgtttaatgaaagatgaattggtgagaggtgagaagggaagagggtttttggtttttttggggtgggaattagtgggttagagtttgttgggtggttgtaagtatgttggtttagtttgtagtgtgtttagttggaaggtggggaatttggttgatattgtgttttgggtttttaggttattttttttgttttgaggttgggttgggagattgtggggttgtgaggagtgtatagaattgtggtggagggtgaggttgggttattggttttttaagtttggaatggagggggaagagtgtagagggttggttgggaggaatttgggtgggtgtgaaggagatgagggtaagaaaagaaatttttttttttttaggagggtttttgaaattttttttttatagttttttttgttattagtatggtaatgaggagtttttgtaatttgatttggaggggtggatgagttttggaaatttagagtttgttggaaaaggttgggggtggttgggttttttttttttatttttttttttttgttgttttttgttttttttttttttttatttagttttgtattgggagttttttgggatgtggagttatttgattgttggatttttaggggtaggaggtgggggagagagatgatgttggtggatgtggttagtgtgggggttgggtggtgtgttgtaggttatttgttggtgttttgagatttaggagtttttgtgtttttgtgtgggttttatagggttggtttatagttttaatatagtagttgaattttttttgttgtgtttttttttttttggaggggaatgttagaagagagagagagtttttttttataattttttttattttgttgtatgtttagagtgggtgtgggggttggtaggtgggaggggtggtggataaatggttgatggtggatgggatattttattttaatgatatttttttttttttttaattggttgtgtagttgtttatgagaatttttaagtttttttttagagagatatatgtaaatttgagttttattttaggttaggggttttgttttttattattttatttttttgaggttgttgaggttgttaaattgttgtttattattaggttttatgttaattttgggtttgtagagagaaaaagttaaatggagattaagaattgatgtagttttgggtaggagaaattgagagtttgtttaggaagttttgttgtataaattataagtaatgttgtataaattttattttaattatgtgtataatgttggaattagatgaaatttatagtgaatgaatgtatgtgggtttggggtttttatttttttttagtttttttttttgttagaataaggaaggtttttttttttttaaggaaggtatattttaaatatgttagttatttttttagttttttgtattttgttttttatgtattgaagtttttttaaatttgtttttttaagagaaaaaatttatgttgattttggatttttttagtaataatgaaatattttttttaaatatttttttttagaatagtatttgtgattttgatttattttaagtatggttaagagggagtatgggtaggaaaggt

SEQ ID NO: 241 - DNA, 5183 bp, Artificial Sequence
  Chemically-Treated DNA
gttttttttgtttgtgtttttttttaattatgtttgggatggattaaagttataaatattattttgaaaggaaatgtttggggagaatgttttattgttattgagggagtttagagttagtatgggtttttttttttgagaggataggtttgggggaattttggtatgtggagaatagaatatagaagattgaaagggtgattaatatatttgaaatgtattttttttgaaaaaaaaaaaattttttttgttttaatgggaggaaaggttgaagaggagtggaaattttaaatttatatatatttatttattataaattttatttgattttaatattgtatatatggttggagtaaaatttatatagtattgtttataatttatatagtaaagttttttggataagtttttgattttttttatttaagattgtattaatttttggtttttgtttggttttttttttttataagtttagggttgatgtgaaatttaatagtaaataataatttaatgattttagtagttttagggaagtagggtgatgaggaataggatttttggtttgggatgaggtttagatttgtatgtgtttttttagggaaggatttgaaggtttttataagtaattatatagttagttggaaaggggaggaggtgttgttggggtaaagtgttttgtttattattagttatttgtttattgttttttttatttgttagtttttatatttattttagatgtgtagtagaatgaggaaggttataaaaggaagtttttttttttttttaatatttttttttagaaaaagaggaatgtaatgaagggagtttagttattatgttggagttgtggattggttttgtgaggtttatgtgggagtgtggaggtttttgggttttagggtgttggtagatggtttgtagtgtattgtttggtttttgtgttggttatgtttgttagtgttattttttttttttgttttttatttttaaaaatttggtggttgagtagttttgtattttggagggtttttggtgtaaaattgagtgggaaagagaaaggggtggagagtgatgagagagggaaggtggggaagaagagtttggttgtttttggttttttttggtgagttttgagtttttagggtttatttgtttttttaagttgaattatagaaattttttattgttatgttaatgatgagaggggttgtggggagagggttttgaagatttttttggaagaagggaagtttttttttttgtttttgttttttttatgtttatttgagttttttttagttagttttttgtgtttttttttttttattttgagtttgaagagttggtggtttagttttgttttttattatggttttatgtgttttttatagttttatggttttttagtttagttttagaatagaggaggtggtttgggaatttggggtgtggtgttagttggattttttgttttttggttgggtgtgttgtgggttgggttggtgtatttgtggttatttggtgagttttggtttattgatttttgttttgagagagttgggagtttttttttttttttattttttgttagtttattttttattgaatggtggggagggggtgggagtgggggatgttttttagtttttattttttggaggtttggtggggtgggtagtggagttgggtgtgtgtagaatgtagtttttgtttttttttgttttagtattttaaattggtttttgtagttgttgtagtagttgttgttgtttaggttgtttgggggggtgattgtgtgttatttagatggtggagtgttggggatttaaatgttattaaaatggtgatttattattgtggaagttggtaaatttttgtaggaggtttagttattggttgatattgttatgtgttttttttttagtgttttttgtttttttgtttttttttttgtgtattgtatatttatattattttttttttttggttttatggaggaagtgagaaagttggtatagttatgttgggttttgtaggattaggttatttagtgatagatggataatgtaagaatgaatttttttttggaatattttatatttagtagtggtgatttggggatttgtttagtttgagtttattttttggattataggattataattttttagttgtgtgtggttagtgttaatagttgtggtggtgatgattgttttttagtgggtaggggggtgtagattggtttgttttattattattattattattattattgttatttttagttggttatttattagatttttgggaatttgggggtgttttatttttatttaagttgtggtttaagttatggtttatagaattttagtgtgttttatagtttttatgtgttaaattaggaagtagatgtaagtggtgggtatttttagtgtgtttttgttgtttattttggaaattttttattttttatggtttagtattattattattattagggttatgttgggggtgtggtgggtttgttttaatatatttattatttatatggataggagtattagagtttggttttggttatgtataataattttttgttttttttttatgttagttattaagaagtttgttgtttttttgtattggagatattttttttagtgtagatttttgattggatgaaagttaaaagaaatttttttaaaataggttagttttgttggttggtggatgttttttgattattttggaaggagttggtatgtttaatttttaaggaaattaataatgattttttttttaaaaggtttttgtattagattagtgttgtagtgtatggagagggtgtttagaggtgttggggtaaagaagttttagggattggtgtgtttttaaggattttatatatttgggaaataggaagtatgtgggggtggttattgtgatggtagtgttttgttaatattttgaggttttattaattattggtttgattatgttaatggtttatattaggttaatattttatattttattatttattttttatagtttgatttgtgttgagtttttgattttttttttatttgagtgttgttatgaagtgtgtggggaattttaagttgatttaaaaatttttatatttttgttttatggttttttattttgttttagggaaagttggagagtatggttatttgggttaatttaatgtggtgtgtattaattttattattaagtagtttatggaattggagaaggagttttattttaataagtatttgatgtgtgtttgtagggtggagattgttgtatttttgtagtttaatgagatttaagtgaagatttggttttagaattgttgaatgaagtaaaagaaatgtgagaaggagggttttttgtttatttttttggttattttgttaggaaatgatgagaaggttgaggaatttttagagaagtttagttttttgttttgtgttttttttttggggttttttattttagatattttgattattttttattgaggtggttttagttttagataatagtttaggtatttttttgggttgggattttttatttaaagtatatgtttagtttatttttttttttatttatagtttttttttttttttttaattttatttggggagtttttggttaggataatatatttgtagataattttggattagagatttggtgtggggttaatatttttatttagattgggtgttagtatatattttttggtgggttttaatattttttttgtttttaggagaatttatagaatttattgttttttttagatgattttttggaaaatagttttttttgttaatagaaatatgttagaaggaatttttttattttttatttaattatatgtatagttttttttttttttgtttttgaaagtaggatatagtgaaaggtgagtttaggagtttaggaagaagagatgtattatatgtttatataattaatttattttttaatttaagttatttttatgtgtgtgagtttgttggttgtaaatattttgttttaagagatttatttttatatagattttttagaaatgtttaggttattaaaatagggtgggtaaattttttaaattggtataattttataggtgaaagaaaaaatttttttatttaaatttaattagatgttttagagggtagttttgatttgtttttatagttaagaagttttgtagagtataaattttagaaatttggttttttgtgttaagttttttttaatttttatttttttttttttgggttattttttgtttaaaatttgtgttgggttatttagaatttaaaagtattatttaaattaattttttttttttatagttattttagttggatataatgtatttttagtttaattgttaatgtgatggatggtataatgaatgtatattttgtgttatttgtgaatagttttttgtatgttgtataatgtttgatgtttttaaagtattatattgagttttattagttattttttgtgagtttatgatattttttattttttgtataattatgaatagttttgagattttggagtgatatgatttagagtagagtttatgggttttaggatgtttgtaataaataaatatatttaagttttaggtatgtttaagtatttgtgtatttggttgggttataatttgttaatttttatgaagttggtatattttatgaggggaaagggagaagggtggtaaatatttttaaagagatgggtttttttttgaataaaagttaataatagtttttttattataattaaagtttataatggaaaaaaagattgatgaagaaatttatgaagtagatttatttttgaaataaatatggatattttttgggttaagtgttaatttttttatttttaattggatgttgatgtatatataaatagaattttttttaaaagttaaaattgtttttagttagtttttttttatattagtgaattaagagttaagagatttatatttaattagttttagtataaagttgttgtgaggatggggtttttattttattttttttttttttttttggattgttaggtagagttttgatatattttatttttgaaatggagtgtttttagtaaatttttgtattttttttttt

SEQ ID NO: 242 - DNA, 20899 bp, Artificial Sequence
  Chemically-Treated DNA
tgtatgatagtgagtttgagagtttggtttttagtttttttatttttttatgtatgtgattaggggatggagagaggtgtttatatttttaaggtttttttttttttttttttttttatttttttttgtttgtttttaggtgtttagttttttttttttttttggtagtttagtatttaagttagagagtggaatatttagaagattatgatttttaatgttttattgggattgtaagtgttataaggttaaagataaaatttaagtatgggattttgttggaaatattagtgttaaaggagttgagttgagttaaatatgggttgtaaggtggattgaggtggtaggtataggtgatatttagtgtttggtgtgggggtttttaggtgatggtagaggaggggatttaagagggggttttttattgaagatattggggatatggggaggagataagatggagagttatgattaggtatggaggttagataggtagtttgggttaggatggttagtggtttaggggagagttgtaaatttggggatgtaaggggttggttggtaagtgtttttgggaatatttattttggtgaggtagaatataatattgggtgggtgggtgttttgatgaatgggtaggtaatttggggtgttttgaagtgttttggattttaggttaatgtgggttttataattgtgataatttggttttttgggtttttgtttaatgttttgaatggtttatttatagggtgtttgttgagggattttttgtgattgaggtggattggtatggatgatttttggggttatgttagttttgttattaggatttagaagttttaggtttttagattgttagttgggttgtgtgtaggggggttgagttgggggtataagtgggggtgaggtaaattttttagaggttgagtttttgttgtagttttaggtgttgtggtggtggttgttatggtattattagatttgtgggttttggggtttaagtaatttggttgatgggtagatttggtagtttttttgttttgtgggtttagatttgtttgatttttttattttttggttttattttattttgtttttaagaggttttatagagttttggattttttggagataaggtagggtgttgaggggtgggtaagatgttattgagggagaggggagggttttttaagtgtgtggaaggtggttattttgttttagtttgatggaattttttgtttatatatttgttagtttttttttttttggttagttttaggttagttaggagtttttttttgtggtttttgagtatttttttgatatttgaggagattttgtttaatttttttttttgtttttaggatttttggggattagttattgtttttagaagttaggttggatagtggttttttttatttttttttgatttttttaagggggtttagtggttagtgttttttaggaggttttatttttaatttaatttaagtaatagggatagatgaaaaataaaatttaattagggtgataaatggtggggggtaggatgtggtggtttttaggttggttttgtgtgtttttgtttttgttattgtttttttgttatatggggggggggtttaatttggtttttgagtgtataaagttaaggaggggtaaaaaaaaaataaaaaaaaaaaaaaaaggaaaaatgttttaagaaataaagagggggaatagattaattgatatgaaatttgggggtttttaatttttttatgtaattttgtaagtttgttgttaatttttttgatttttttatttaaaattttttgggattattttttattttagaattttttttgtttagtttttattgttttttatttatttttttaattgttagattttttatattttttgtattagtgtatggtttttgaggattttatattttttggggggtttttaggagatgggtaaagatgatttttaggtgtgttttggtgggggggtttttaagattttttttttaggagtatattagggagttaggttatttgtgggggtatgtttgtttagttattgttatttttaatgtggttaaattttttttttattttggttgggttaatatatagtaagtaaggtgtattgggaatgggtggggtatggggagtattgtggtttatgttgtgggggttgtggggataggtgttaaggaggttagttttataagggtatttttgttatggtggaaagatggaattaggtttgggatatattttgtttattttatgggtgtattttaaatgttgttggttgtatatttaggttgtattatttgagtttttttttttgagaggtagggtatagatagggttgaggggtagtggagatgggaataggagtggggtttagattatgaaaatattggagaattttagtgggattttggtttgatttatatagatattgtagttgtttagatatgtttattgtttttatttaattttgtgggggtgtgtgtgtgtgtgtgtatgtgtgtgtgtaggtgggtgtttgtgtgtgtaatgtgtgtgttgtgtgtttgtgtgttgtgagttgtgtttatgtatgtgttgtgtatgagtgtgtgtgttgtgtgtgtatgtgtgtgttgtgtgtttgtgtgtgtgttgtgtttatgtgtgttgtgtatgtgtgtgtgttgtgtgtgtatgtgtgtgttgtgtgttgtgtttatgtgtgtgttgtgtgtgtgtgtgttgtgtgtatgtgtgtgttgtgtttgtgtgtgtgttgtgtgtgttgtgtttgtgtgtgttgtgtttgtgtgtgtgtgttgtgtgtgtatgtgtgtgttgtgtttttgtgtgtgtgttgtgtgttagtgtgtgtgttgtgtgtgtatgtgtgtgtgtgtgttgtgtgtttgtgtgttgtgtgtttgtgtgtgtgttgtgtgtgtgtgtgtgttgtgtgtttgtgtgtgttgtgtgtttgtgtgtgtgttgtgtgtgtatgtgtgtgtgtgtgtgtgttgtgtgtttgtgtgttgtgtgtgtatgtgtgtgtgtgtgtgtgttgtgtgtttgtgtgtgtgttgtgtgtttatttgtgtgttgtgtgtgttgtgtgtttgtgtgtgtgttgtgtttgtgtgtgtgttgtgtttatgtgtgtgttgtgtgttgtgtgtgtgtagttgtggggatgtataaagtatgagtgttttttaggatgggaattgagatgtaagatttgggggtgagggttgtgttaattatattttatttgtatggattttggtttttatgttttgttttttttttttttggttttattgggtttttttgattgttttgtgatttttagtgatggaaaagggagtgaggagttagtttgggttgttgttatttttggatggttagtttattttgaaaatttttgtgagaagggagatggtggtagtagtgatgtgtttatttgtgatttttggggttttttttttttttttgttggtttagggatttaagtttaggttaatttgatttaaagtttaagggagaagagaaagaggggggtggggagtgttaaatttttttattttgttaattgttttttagttaatttgtttttaatattttttttttttagttaattgattttttttggtggttgttttttttaaagttaatttttgagtttttgtggggtgtttttaaaaagttaattagttttaagagggttgttgtgggggggggggaagggggttagtttaatgttttgattttttatgtgtggggataattggggataatttggggggagggtatgtgaagggtgtttaaagttaattgattttgtatatgtttgaagatgttgttgtgtttttttagtttgatggagggggttgaggagagtagtttgttttggggaggtggggtatggggattgggttaggagaagttttagggggatgtggaattgagagatttttgggatggaatttgatggaaatgtttgtggttaggaggaggttgtaggatggtggtgttgggttgtagatttgtggtagttttgtttatttttgattgttggttatttttgggggggtgtttttgtgggtggggttttgggtgggtagagtaattaggggatggtgatgtttggtttttttgaatgttttgagttttttggtgagtatgtgattttggtgggtatgtaggagggtaggtaggtttttgtgtaggtgttgggtggattgtttttaggtgttatattggaagaatttgtttatggggtatttggggaagttgttttgggaggggaaggggttggttagtaggtgtttgttttttatgtttttttgtttgagttgtttgtttgatttgataggttatttttgtgattgattagtgatttgagttaatgtttatgggtagagggatagaaggagttagtgtttgagttgtttttgggttatatagtaagtaaggaagttatgggtttttgtttttggttaagaggttttagaggttataggaaatgttgggtgtttgaagttttatttttttgtttttagagagtgggaaaggggtttaggatttttattggaagtatggttggaggggttgatatgttttttttggatttggtgggggtagtatagtatgtttttaggagggttaggttatagttgtggaaatagtattttttaatgatgttatggttgtgatggtttatatggtttgtgggtttgtttggaagttttatagtatagagagagttgtgttagtattgtattgattttagtttttggaggttgaagggggagtaaattatttttgtttttaggttaggttttggaaggatgtagttattttgtgggttaggggagggaagtgagagttggtaggtagaggtgttttaggaagaagagaggtgagaggggaggtgagtgggatttagattagtttgtggtttttgttgtttttttttttagatgaaaaatgggtataagtttttggttttataattagagggatattattaggattaaaggtttataatgggagtggtttggaaaatgtgtgggatgtgagtttagtttaggggtttttataggagggattgttgtttttgagtttggattttggtttggtattatttaggaggttggaggggtttatattatttttggagttgttgagatagggagataagggtaggagaggagaagatgggaggagaggagtgaggaggtgtgatggaattatttttttttttttttttgtttttttttttttttttatagtaatgtttagttggaaggggaaggttgttgggggttttattttggggtgttaaagggtaggtgttattagttggaggagggagtaggagttttattatgggggttttttaagtgggggtttggtttttttttttttttaggaaagtttggtgtagggaagtttttttttgggtaaggattggttggtattaggttttgtagtgttattttttatttttaaatggggtaggtaagagagagggtataggagaggttagggtgggtaggggtttttagagttaagtagtaggaattttttagagagaagttttgaagtgtatttgtattttgtgagtttattttatagtgtgagtaagtagtggtggtaaagatgttatgtggtgagtgttaggtggaataagttgtgtggtttttgttagtaaggagtggttttttttttgttttattaggtatgtttaggtattatgtttgtttttgtatttatttagtttttttatttgggggtggggttttaaggataatgggttatgtatttatttgttagtttttaggttggagaattaagagagaaatatgaggaaaggttgaagtgtttttgaggttagtaggtgggtattttttatggtagttttggggtttaaggaggtgtatgtattgtttatttttgttatttattaattgtatttgttttattgattttaattatataaattattttattgattttaattttgattatttattgaatgtatgttttttgttagaatgtttaaaaggtgtaggaagaaaggtaggttttttttttagagtttgaagttttgtattaggtgtgtggtgttttaggagtaggagttttatggtttttaatagaaattttgatgtttagggagatttttgtgagtgtttttgatgtttagggggtatttttggtttattttttgaaggaggtgtgtgatgggaaaggtagttggtgtggatgttttgggatattgtatgtgtttagaaatgtggtgggaaggttaaagttttagagtaagtggttgggttgttgatttaggagtgtgtttttttggtttgaggttgggtgtttttattggttattttaggggtttgattaggtttgaggaagttttttttagttatttattgaagtagaagttgtggtttttatagatgaattggagggtgtttattagttttttgttgtatagggttttattggggtggtaagtagtaatgtagtatgaggtgaaggttaagaaggtgagaagtattagtattgatttttttattgggatttttattggtgtttgggggtgggagagaagtggtgtgagtggggtagttaggttaagttttaggttagaggtgttttttttaaattaaatttgttaatttataaatttagttgaaaattgaaagtatggtttttttataaatattatttttattataaaagtaatatataggttataatgttgaggtgagggtgtagggttatgtgtagaatgaagtgtttagaagtatatagaaaaggtttagttttttttatttgtaagaagtattagtaattttatatgaggggtgattatttttatggttattattgtaggagtttagtggtatttatagttgtaggggtttaggttggatatttgatttggtttttgttttatgatattatgggggtagggttagtttagtgttatattgttattttttaggtttttagtgttagttaagatggtagatagttttatttttatagagtatgtgtatttaggaggattagtttttttttttttataatttttagttgagtagggggggtttaggaggattattgtttttaaagtagtaggttagttttgttgggttagttttgtttttttttttggtttttttatttttttagtttgtagttgagttaggtttgggttaaggattttaatggttaatataattatgttatttatgttttagaaattttgtttttttagttatttagttttttaattttagtttgttttgggtatttttaaatatatatatatatgtttagagttttttttttaggttttaaattgaattagtaaggttaggggtttttagaatatttttttatttgtgttattaaattttttttgtgggagttggagagattagtttaggttatttgggaagtttgatattaggttttttagattataatttggaaggggaggttagttttaggatatattttttttataggttgtagggttatagggttgggttaatttatttgggggtgggaggttgggagttattatagtaagttggttttgtttttgtagaaggtggaattttttaggtgggtagttttagtttttgttttgtagatttaggggagtttttgatgtaataaattatgtgagtgattgagtaggtagtgggatagaagtataattttgtatgttttttttaaagattagtgggtagttgtgttgaggatttgaaagtttttttggttatttttttgattggattttggttagtttttttattgttttttttgttatttttttttaaattttaagagtatattttgttagttggttattttagtttttgttgtgtttttgtaataagttttattattttgaatttggaggtttgggttaggggattggtagaaagtaggataggaagtatgtagtggtgtggagtaggtgagggtttaggaaaagttttgagttgggtaaggagggggttgaagggaaggaatagaaagggaaggagtaggtgagggagtagagattaggtgggggtaggggtagaggaaaagaggggaggggggtgttgtttgagaggtagtgggttggtggttgtagggtttgaggtttaggtgtgggttgtgttttttgttgttttgttttaggttggagtgggatggtagtgggggtttttattttatagttttggttatttatagtttagtagaaggtttgttggggtaggaggaggaggaggaagaggaggaggaggaagttggaagttttttttataggagaagttaatgtttagtttgtaggttggttagtgttttagtttttatgtgtgagttgattttttttagtttgggttttattttattttttatttttttttttgttgattatttttttgtgtttttgtttttgttttttttttttttttagttagtttttttttttttgtatttttaattgggagttttggattattttgtagtgaagtgttatgggtttttattttgtatttttggtttatttttgtatagggtagtgaagggggggggggttttttttttatttttttgtatggaaatttttatgttgtttattgggtaggggttgtggtttttttttgggttgaaggttttgttttttttagttttagattagtagttttttttttttttttttgggatttttgtttggaaatgttgtggatagagttagagggggtgtgggggagatgttgtgaatgtggtgtttgttatgatttttgttaatttggtttttttttattttggttttgtttatttttgttttttttttgtggttttgttggtattgtgttaatatattagggtgggtttttgtggttttgtgtttttttttgttatttagtattttggaggttagggtttgtaaggtatgaattatatatgtgaggtggtattttttgtatttatagattgattgggaagttgtttttgtagatattttatattttttttggttttttttgatgtttttattttatttttagttttgttgttagggtgagtgtggggttttgtgtagggaatgggatttgtagttgtttgtttttttttttttttttttttttttttttgggtttagttgttttgttgagttttgtaggttttgggttgggagtgggtggaggaagggttgggtgtttggtgtaagtttgtgttgttttagttttggttttggtttggtttgtatatgttgtttatttggaagttggtgatgttgttgtttatttttttgttgtgtgttgtaaattgaatagtgggtgttggtttttttgttggatatttttttgttagtgttgttttggttgagttgtgggggttgaatgtgtgatggggtagagtggggggatggtttttttttggggggggggggagaatttgtttgattgtttagggaggatgggttgtttttgggttggggtgggttagatgttgtattttttgggggggaaaaggtattgggaaatgaggttagttgttgtattaaggatagaggggggtagagatagtgggagagatagagtgaatgtgaaaggggggggttgaagagagggtgagggggagagaggatagtgagaggtgggtaggtgtatagtgggagagaatagtatggagagaaatagaaagtgtgtaattaatttattttggtttggtgaaggtgagagggtgggtgtgagggggggagggagttggaggttaggagttgggggggatgggagggagtgaagggaaggttgtgggagaaagagtgggggttggggttagatgttaagaggggtgtggggagtatagagaagtggagggaagggtgttatgttgaggggttgggggaggtggtgattggggggtggagtggaggttgtatttggattgtgggtgtttagtttggtttgggttgatggagttttttgttgttgtgagtttgggttttgggagggggataggtggtggtggtattggggttgttttgggatgtagtgtggaaaggggagtggtttgaggttgtgtgttggggggagggttggagggggagtgtgggggggggtgataatgttggtggtttgtgagttggattgtttgtggggggaattgtttttttgggtgaagtggggatggggggagttgaggtagatgaagaggaggtggtggggaatttgtaggtttggtggagtgtgattttgtggatggtgtttgggatgggagttagtagtgaggtagtgggtggtgttgatgtggggttgttttgtttgatggaggtgttggtgggtagagtgtgggtaggtgtgggttaggaggtgggggtggttggaaggggggggttggggttggttgggttttatgtagttttgttggagagtaggtgaattgtgggtgtttatgtttggtttttatagttgtgttagtttgtggtttagggtttgtgtgggttttgttggttttgtgtttgtgttaatgggtgtttgtggagtttttgttttgtttttggtttgtttttgtaatttgagttaagagtggggtggggggtgtgggttgggggttttggggttttggggggggggtggtggttgtaggggttggggggtgtgtgggggtgaggttgggtggggggtagggagttgtagagtgttaaggttatgttgaatgtttgttttagagaatttaggggttttattttgggtttttggggtgtttgggtggtttgtgtttgtgagttggggtttttgggtaggtaggggtaggtgggtttttagtgttttattaggaggttgtattgtgggtgtgttttgtttgagtgtagatgtaggtggtttggggttgagttggggggtttttgttggttgttgtggttgagggggtttttgggtttgggtggggtgtgtagttgttatttgttttagtaggaggagttggttatgtggtgtttggagttttagttagattttgagtgttttttggtgttgtgttggagttttggagtttttgttaggtgtgggatgtgtggaaggttggttgtgttgggttgaatttgggttaggtttggagtttatggaggttttggttgttagaggagagaggattagggtgggaaatatagtttaaattttatttgtatggttgagtttattggggtgtgtttaagtagtttgtttttgtggtttatttaaaatatttggataatggttattttgtttttagtgtgttggatttgtatagatgtgagtttggttttgggggttattatgataatttgggggtttggggaaattattttttggagagtttgaatgatgtaagaaagtattgtgatttttattaagttaaaaattatgtataaaattttgtattttgttagttttttgttgtttaagtttagttaaggggaaggggttgttggtggaattttgtgtttttttggttttttttgttttttttgttttgttattaattattttgtttgtgttttgtgtgtgttttttggtggagttttaggtttgtgggttagaggtattttattgtttggtgggagtgttttttttttgtgttttttgttttagttttttgtttgttttattttgggattttttagttgttttttttataaatgagatttttgtaatgagtaaatgaaagtggtgtggattttggggtgtttagtaggagtgagtgtagttgttagttgtaagtttgtagttgtgttttgtgttttatgttggtttttttggtggtagttggagatgagtgttagtattggtgggatagtagtagatgtgggttgagagttggttaggggtgtagaggtggaggggattggtgtggtggggagtttattgtgaagttggaggttgtgtttgtgggtgtattaggagtttaggtagtgagtgattgaatgttttgtggtaggtggtggatgttgttgaaggtgagtgagattttggggttagtttttagtgtttgggagtaatgtttagtttgttggaagatttggggataatgtttaaatttgggggagattgggggtaatgtttggttgtttttttggatatggggaagttttttttgtttatgttttgagggtgtgtggttgatttaagtgtgtttgggtaatgttagagagaaattttttaaatttgagttgttttggggattttgtaggagatagagaggtttgaaattagtgtttgttgtgtgtggggttggggaagttgtagtgggtggttggtgagttgggaataatgtttaaattttggggaatgtaaggtagagttttttttgttttgtgggtttagtgaatgggtgttttggaggaggggattttggggattttgttaatgtgggaattgtgattaatgattaaatttgagattttagaaaaatagattataggtttgggggatgagagaagttgttttatgtaattgggaatatagagaaagaggttttaaataggggttagttagtttgggggattaatttgtgaggaggggtagttaaagaaaattttttatatgaaattgggaattttgttgtagagttatattatgtaaaattggtagatgaaagtaaggaatatattttggggatttaaatatatttttggtgtgttagggggaagttgagattaatttttatattttaagaatataagttagtggtttggatgttggtagtagttggggaaaaaataatttttataattattgtggttttagggaaaggttttaatattttttagagatggaagaaagtattgtttagattttgggggagtttggagtgtgattagtatatttggggaaagtaaaataaaaaataaaaaaataaaaaattagtattatttttttatgttaatttttaaatgatttttattagtttatttttggtaaataagaaaaagattatatatttttttggatgttgtttgtatttgggggagttttagtgaaatatattttaagtttttgggatatatggaaattatttaatggagatttgatatttaaatttttggaaatttagttagtagttaggaaatttataggttgtaggtttttttatgtttgggattttttgggatttagggatattttttagtgtgttttgggggtttatggaatattttttaaatgtagggggatttagggtagggattataaagttaggagatttataaattagtattaaaaaaaaaaaaattttaattgttttgtgaagggaaaaaaattttaatttgttttggaaggttgggagataatattgtaatttgggggttttaggaaaattgtttttgaatttaaagatttagggaagttgtttagagtttttggaggatttgggggtttatatgtatattttaaagaaaggggatttagaatttttaggttttaggatttaggaatttttagattttgtgatagggagtgtgtagtgtgtttgaaggaaatattgtttaattttgagatgatttagtgggttgtttggagtttaagaaattagtgttgttttgtgatttgagggtaatgttgaatgtttttagagggtttggagggtagtgtttagaatatttaagtatgggggattaggaaaagggtttagtgtgattttggttgttggggttttagattaatgtttgaattttagaaaagtaagatttttgttatgaagtttttgggatttagagaattgtttaatagttaatatgttgtgatgtagagaaagtgtttggaatgtttgggaattggggttgttagtaatatttggtataatagaaataaaagtaggttttgtttaaggggtttttttgtgtttggtgtagtttagagggatttgggagattttgtgtgatttggggggatttggagaattttgggttatatttgagtattttttggtaattgtttagtgtgttttagggatttgggtggtattgtttatattttaagggatttgatttgtggttaggtagtatatagagttatagatgttaatgttttaaagttttgtgatttatatatttataatatttttaatagttttggggaattattggggaaatttttttattttatgaaatttaggtaattagagggtaggttgtttatgatttagaaaaggatttaatatgttttgggtgtaatgattgaatttgggggaaggtatgggaagtaatttttatattttgagggttttaattttttagttttgttgagtgttatgagggatttgggatttaatgtgtaaagtttagggaatttaggttagtgtgaatagatttgtgggatttaatagtaaatgttttatgttgaggtgaatgggaaggggtgtgggggtggggtgggggggtgtggaatggggtggatgtgtgttggaaatagtaagtttaggagattttggagttaatatttaaaattatgtgggaaagttttatttgttttggaaataatgtttaaatgtggaaaaggtattgtttatattttggggagttaggtaaattggttagtgtgattattatggattaagggttttgtttttaaaattagggaagttgggttagtggtttgtaaatttgtgggatttggagggggtgtataaaattgtttagagtttgggagaaagtatatttggggttttaggttatatagtgtaagtttggaaaagtttgttgggattgatgtgttttgatgtttttggaaattaatgtttaagaaaattattgtgatttgttgaaatggtgagtatatttagaagatttgggaagtaatgtttaaatttagaggattttagaaaaagtaaaatgtttgagtttggggaaagtagggaagttgttttgtggattggaattttttgaggattaagggttaattgttgagtttaagttttttgggtagtggaaggaaggtgttgttggggatttattttggttggggtgtgtgtggagtattggtgttttttttgggaatttgagtgtgggtggtgtgggtaggtagtgtggagtgttttggtgtgtatggttggttgaaattttgttttttgttttttggggttttttttttttttgtttttatttttttttttttttgttttttttatatggagagtgtgtttgtggtggtagtttgagtttagtgggtgtttgggtgtaaggaagaaatttaagggttgtgagggagtgattaggatgttgttttttgggtgtttttgggatttttagatatttgtttggtttttgtgtgggaggtttgtaggtttttttttgttattgtgttttatttgtttttgtgttgtgagtttaggtgaagttgtggttgagttgttattgggggtaggttagtttttggtttggtttgggggtttggagtatttttggtggttatttttggtttgttttggagttttgtgtgtgttgtttgggtttttgttagtattaaataagggtgaaattagttttgtttgggtaatattgaagagtagaggaagtggggaggaaaatgagaaatatggggtttgggaggaggggggtgtagggttgtatgttgttggggtgttaggggtttttttttgttttttttaagtgaatttttagggaaagtttgtttattttggttggggaaagtttagttttttataggtaaatattaaatttgtatgtaggtgtttaatggttttgttggtaggaataaggttattttttggtgttgggtaatgttgggtgatggggtagtggttttaaggggatttgtggggtgggtgggggtattgttagagagggggtattgttggggattagtagaatggtgggggattttggggtaattatagtgggtattgtttgtttttattgttattttataggaggattttggttagaaggggggtattttaaagtttgatattggggaggtagaagttaatggttttggataggtgtggggagttgggtaggatgaggtattttttttatattagtttggtaagatagggagaatttgtttttattatgaaaaatagtttattttttatttatagaataagatatgtgggaatgttttttttaaatttttgtttgtattaattatttttatgttttattttaagaatatttggtttatttttttttatttattattgtttttttttttattagttttttgtagtttttttgtgtttttagttttttggtttttttggttgtgtttatagaagggggagtttttagtagagaatttttggttgtgttgatgtttttttttgtagggtgatttgtaaatttgggggtgaggagtatttgaaaggtgtttgtttgtaaatttggtttttgggagagtggattaggttgttgaggtttttgttatggataaaattagggtttttagggttagttttaggttttttttatttttttttttatgtttgttttttaggttggggataggttgggtattgggggtgagttttagttttgagttgtgggttttttttttttttgggggtgttggggataattatattagtgatttgtttgggggttttttttttttgttttgttttgttgaggtgtttttttttagggggttattgtttatgtttgaaaatgtatgtttggattttttaaggtaggaagaaggttgagggttattttggggtgtttatagtagggtgtagtggttttgtagggagggaggagtaggtgggggagtgggggtgtatatatgtttttttttttttgtggggttgtttgttgagtgttttttttatttagttagaagtgattagggtaggttggaggttggggtagatgtgggttattttgaggtttgaaaagtatattggtttttttttagttaagattagtattggggtttttttttaagattggttttttttttattatttttagtttttggaggtaggaagggttttgttagtagtttaagggtgttgggagggggttagggtttttttttatttagagtttggttggtaggaattttagttttaagtagtgtttgttttttagttttgaattagtattttattagggtaatgttggttttttttttattggtaaatttatattttatagaggatgaatatttttttaaggatttagatttattttatggagtttggtttatgttttagttttggtttgtggttgttttttatttttttgtttattagttttgaagtgggttttttttatttttattttttttttagttttggttttgagtttattgttttgttgtttgtgggattaagtttagtattttataaatttagtttttttttttaagggtttttagagtgtttttttgttattttttgtagggtgttgtagatgaggtgttgattttgtgtttattttttttgttggggaaggatatatttgttggtgttagtttggttggtttgggaagtaggattaaggatttgaattgtaattttttatattagatagtatagattattttaaggttgtttaatttgtttaaagttaaaagtatgtgggggatatgggtttaggttggggtgtttgggagagggttttgggagaggggtttagatggtgtatattttaaaggattgaggtggtgttattgtgttattattttattgagtgtttaaggtaaagatatttttgaaagaatatttttggtttttatttgggatgggtaaattagtttgaagagttatttgttggatttttttttgtaggttttgttgtggggtaggtatagggattttaatttatgtgtttttagttttaatgttttttaagttttggagttttttttgttattttagtgtttgattagtgaatgggtgttgtttttattatagagttttttttggttgaggtagaggttattggttgggtttttttagttattttttattttttttgtatatgggaagttttgtaggtttttgattataatgggattttgatgttggagttttttaggttttttgtttagaaggtttttggttattattttaattttgaatagttaggaggtttgagattgttatttattttgataaatatagattgatagaaaggttaggttattggtgtaagattttatggttagtagtttggggtggggagaatttgggggttttatagtttttagtagagtttagttttttttgggtttttaggtttttttttaatgatattttttttttttttttttttatttattttttgttttttatttttttttttttggttgtttgttttttttttgtttttttttttttttttgtttttttttgttttttaggagtttttttgttaggattttggtgttgtggagattgtggggaatttgttttgtttatatttgttttggtttttagatggaagtatttggagttaattatggaattttagattttagttgtgtgattgaatttatgttagtttttttgagttaaagttgtttgtagaagggggagattttagtttgaagatttttgtgtagagtttgtggttttttttgttaggttttagggtgtttgagatatttatttttttgttttgtagttggggttgaggttggggttggttgttagttttagttttgggagtgttggggttgtttgggttataggttatagtagtttattttaggattgggttttttggtttgttggggtttaggttgtggggtaggttgggtagggggttgagttggtagtgatttagagttttggggttgggggttggaatttatttttttttatataagtttggtggtgattttttggtttttggggaaaaataaaaagatattgttgagatgattttttttaaaagtaaagtttttttttttatatattttaagtttgagttttgttttatttttttttttgggtttttttaggttattttgttaggatttgggtagtggtttttttttttagttttttttttgtttagagtttttttttttaaagtataagggagggaagaagtggtgagaagtttgtttagaaagggttttttggtgttgatggagaggttgagatttttttgttggataggttgttttgtttttgggtgaggatgggtttttgtttggtattgggggtggagggtgtatatgaatggtttgttttgaggggttatggtatggaatatgaaagttttttttatttttaaatatttttattttggaaggagataaggagggggttttagtaaaagttattggatatatagttttgtttgatgaggttagtgagggatggtgtggttgtgttttttggggaaatgaattttttttttatagatattattttgggtggattgaggagtttgggtttagggtgtaatagagaaaaattttatgtatgaatgagtatttttagggaaattgttttggttttagggtgtttttttgtgttagggaggttgggagagtagtaagggggattaggtgtgttattaggaggagagaagttaaatttaggggggatatggagggtggttgttgttttttttggtatttttttttagttttttgtttaattttttgttggtggttaggaggtatagggaggtaggagggaaggaagttttatttgtaaaatggtgtatatatgtataaataaaatttttgtgttagaattttgggtttttggtttttttgtaaagttttttgtttgtttttgggaatgggatgggggatgtaatgggaggaaattttttatatagaaagatttttttttttatatttgtgaagatagttgtgtgtttttgttgggaagagtggtttagttttttttttttattttttttattttgtttggtgaattagttaaggaaaatttattttttttgtaaaagttttagtggttttgtgtagttttaaaggagaattttttttataatggttttttttgtatattttatttttgaagttgaggttgtttttaggaggtttttttgtattttttagtagtagaagtttttttttttttttagaaattaggattttggtagttgttttaagtttttggtttatttatgtttgaatatttaaagtgtagttttttttttatatttaagggatgggagtttagttatttgtattttagtttttgtgtagtttttgtagtttttggatagtggataaagaggattggggagttattggtgtttaaggttttttgttgaaattgtttggatgatgatttgttggtttggttaatattagtagttattattaaagtagggggtgttttggttgtggtgtttagattttttggttaggttgatgtggaggaggagagggataaagttgaggttggagaaatgaagggtatttttagagtgtgtatgttaatatggtttttatagatgggagagttttatttttgttgagtatggtatttgtttaaatgttaattgaaatgatgggtttattttttatttttttattttttttatttgtttttttgagtttttttgaatttggggagttttgtgttaatttggtagtgttgaggttgttggggtagttggtttaggtattttttagtattagggtatggtatattagtgggtggaggtttggtttatttttgatttggtagaaaggtgtttgtgggtgtgggtataagttagaagttttttgttagttaggaggtgggggttatgtggaggtggtggggagtgggtgtagttttatttagagtgatatttggtagttatttgatattttggaatgttggtggatgtggtattggtaaaatggtggggggggggggaa

SEQ ID NO: 243 - DNA, 20899 bp, Artificial Sequence
  Chemically-Treated DNA
ttttttttttttttgttattttattagtgttatgtttattaatattttagggtgttaagtaattgttaagtgttattttaagtaaagttatatttattttttattatttttatatagtttttattttttagttggtagggagtttttggtttatgtttatgtttataggtgtttttttgttaggttaggggtgggttaaatttttatttgttaatgtattatgttttggtgttggaaagtgtttgagttagttgttttagtggttttagtattattaagttggtataaagttttttaaatttggaggggtttagggaaatgagtggaggggatgaggaggtgaggggtaaatttattattttagttggtatttgagtaggtgttatgtttagtggagatgaggtttttttatttgtaggggttgtattaatatgtatattttaaaagtgttttttgtttttttagttttagttttgtttttttttttttttatgttaatttggttagagggtttggatgttatagttagggtattttttgttttggtggtgattgttaatattggttaggttggtggattattgtttaggtagttttggtagagagttttgggtattagtgattttttggttttttttatttattgtttaggagttgtggggattgtgtagggattagagtataggtaattgggtttttattttttgagtgtgagagaaaagttgtattttaagtgtttaggtgtgggtgggttgggagtttggggtagttgttaggattttggtttttgaaggaggggaagaatttttgttgttggagggtgtagggaagttttttgagagtagttttaattttagggatggggtgtgtaggaaaggttattgtggagagggtttttttttagggttgtataaagttattgaggtttttgtaaggaaaataggttttttttgattaatttattaagtaaaatgggaggggtaggggaggagggttaggttgttttttttagtgggaatatatagttgtttttataagtgtgaaaggaagagtttttttgtgtgaaaagtttttttttgttgtattttttattttatttttagagataaataggagattttgtagaggagttaggggtttgagattttggtgtagagattttatttatatatatatatattattttataggtaaagttttttttttttttgtttttttatgttttttgattattagtaagaaattggataggagattgaggagaaatgttgggagaggtaataattgttttttatgttttttttaggtttagtttttttttttttgatggtgtatttggttttttttgttgtttttttagtttttttggtatagagaggtgttttggggttaaggtagtttttttgggaatgtttatttatgtatgaagtttttttttgttgtattttggatttagattttttgatttatttagggtggtgtttgtggggagggggtttatttttttaggaagtatagttatgttgttttttattggttttgttaagtagagttgtgtgtttagtggtttttgttggggttttttttttatttttttttaaggtgggggtgtttggaggtggaggaggtttttatattttgtgttatgattttttaaggtgggttatttgtgtgtattttttatttttagtgttaggtagaagtttatttttatttaggaatagggtagtttgtttaatagaagggttttggtttttttattagtattgggaagttttttttaggtaaattttttattatttttttttttttttatattttgaaagagggagttttaggtaggggaggggttagagggggaagttgttgtttagattttgataaggtgatttgaaggaatttggggagggggatgggatagggtttaggtttggggtgtatggggaggggggttttgtttttaaaagaggttattttagtaatatttttttgtttttttttaggggttgaagagttattattgagtttgtgtgggaggaggtggattttagtttttagttttagggttttgaattgttgttagtttagttttttgtttagtttgttttatagtttgagttttagtaggttagagagtttagttttgaggtgagttgttgtggtttgtggtttaggtgattttagtgtttttagaattgaggttggtagttagttttagttttagttttaattgtgaggtagagaggtgagtgttttaggtattttgaggtttggtagagagggttataggttttgtgtgggagtttttgaattgggattttttttttttgtaagtagttttggtttagagaggttggtgtggatttagttatatagttgggatttggagttttgtggttggttttaggtgtttttgtttaggggttagagtaggtgtgggtagagtaggttttttgtagtttttatggtattgaggttttggtaggggagtttttgggagatgaaagagggtaaagaaggggagaggggtagggagagagtgggtagttaaaggggagaagatggggggtagaaagtgggtagagagggaaaaagggaaaatattattggggaagaatttaaaaatttaaggaaagttgggttttgttgggggttgtgagatttttgggttttttttgttttaggttgttggttatggggttttgtattaatggtttgatttttttgttggtttgtatttattaaagtgggtgatagttttaggttttttggttgtttagaattgaggtaataattagaggttttttgagtaaagggtttaaggggttttggtgttaggattttattgtggttaggagtttgtggggttttttgtgtgtaagaggggtgaaaggtggttagaaaggtttagttagtggtttttgttttagttagagggagttttgtagtgggggtagtatttatttattggttaggtattggggtgataggggaggttttaggatttggggagtgttggagttggaggtatatggattggagtttttgtatttgttttatgatagggtttgtagggagggatttagtaggtgattttttaggttgatttgtttattttagatagaagttgggagtgtttttttaaaggtgtttttattttagatatttaataaaatggtaatatagtggtgttgttttagttttttggagtgtgtattgtttgaattttttttttagggtttttttttaagtattttaatttggatttatattttttatgtatttttggttttgggtagattgagtagttttggggtggtttgtgttgtttggtgtggagggttgtagtttgggtttttagttttattttttaggttggttgggttgatgttagtgagtgtgtttttttttagtgaggggagtgagtgtaaggttagtgttttgtttgtggtgttttgtagggggtgatggaggggtgttttgaggatttttggagaaaggagttgggtttgtaaaatgttgggtttggttttatggatggtggagtggtgagtttagagttagagttggggaggaaatgggaatgagaaaggtttattttagggttggtgagtgaggggatggggagtagttataggttgaggttggggtatgggttaggttttatggggtgagtttgagtttttgaggggatgtttattttttgtggaatgtgggtttgttagtggagaggagattagtgttgttttggtgaggtgttggtttagggttggggggtggatgttgtttggggttaaagtttttgttggttaagttttgggtgggaggagattttggtttttttttaatatttttggattgttggtgggattttttttatttttgggggttggaagtagtgggggaggagttagttttgaggaagaattttgatgttggttttgattagaggggagttggtgtgttttttgagttttagggtgatttgtgtttgttttagtttttagtttgttttggttatttttgattaaataaggagagtatttagtaggtagttttatgagggagggggaatatgtgtgtatttttatttttttatttgtttttttttttttatagggttattatattttgttgtgggtattttaaggtgatttttagttttttttttattttaaaaagtttaggtatgtatttttaagtatgagtggtggttttttgggggaaggtattttggtagggtagaataaagggaagggatttttaaataggttattggtgtaattgtttttagtatttttaaagaggaggagaatttataatttggaattggggtttatttttgatgtttaatttgtttttagtttgggaagtaggtgtggaggagaaggtggggggagtttagagttggttttgggggttttggttttgtttatgatgggagttttggtaatttagtttgtttttttggggattaggtttgtagataggtattttttaaatgttttttatttttaaatttataagttattttgtagaggaaaatattaatatagttaggggttttttgttggaggtttttttttttataggtatagttggagaggttagagagttggggatatggggaggttgtagaaggttggtgggaaggggggtagtgatgggtggggagagatgggttagatgtttttggaatgggatatgggggtgattgatgtagatagaaatttgaaggggatatttttatgtgttttgttttgtgggtggaaaatgggttgttttttatggtgggggtgggttttttttgttttgttaagttaatgtgaaagagatgttttattttgtttagttttttatatttgtttaaggttattaatttttgtttttttagtgttaggttttgagatgttttttttttagttggggtttttttatggggtgataatggggataagtaatgtttattgtagttgttttaggattttttattattttgttggtttttagtggtgttttttttttggtagtatttttatttattttataggtttttttagggttattgttttattgtttgatattgtttaatgttaaggggtgattttgtttttgttgatagggttgttgggtgtttgtatgtgggtttaatatttgtttataaggaattgggttttttttagttggagtggatagattttttttgaaaatttgtttggagagaatgaaaagagatttttggtattttagtggtgtgtagttttgtatttttttttttttgggttttgtgttttttatttttttttttattttttttgttttttagtgttatttaaataaaattggttttatttttgtttggtgttggtgaaggtttgaatggtgtgtgtaaagttttggggtaggttggaggtggttattgggggtgttttgggtttttaagttaagttggggattagtttgtttttggtggtggtttggttgtggttttgtttaggtttgtagtgtggaggtgagtggggtgtagtggtgagggggagtttgtggattttttatgtggggattgagtaggtatttgggagttttgggagtgtttgggaagtagtgttttggttgtttttttgtggtttttgggttttttttttatatttggatgtttgttaagtttgggttgttgttataaatgtgttttttgtgtggagaaggtaaagaaaaaaaaaaataaaagtaaaaggaagaaaaattttaaagaatgaaaagtagaattttagttggttgtgtgtgttagggtgttttgtgttatttgtttgtgttgtttgtgtttgggtttttggggagggtgttagtgttttgtgtgtgttttagttaaggtgaatttttggtagtgttttttttttgttgtttgggaagtttgagtttaataattagtttttgatttttgggggattttaatttatggaataatttttttgttttttttgaatttggatattttattttttttgggattttttaaatttaagtattgttttttaagttttttaaatatatttattattttgatgggttataataatttttttggatgttaatttttggggatgttaaaatatattagttttggtgggtttttttagatttatattatgtggtttggggttttagatgtgtttttttttaggttttggatagttttatatattttttttaggttttatagatttataggttattaatttggtttttttaattttaaagatgaagtttttggtttgtggtggttgtgttgattaatttgtttggttttttaggatgtggatagtgttttttttatatttaggtattgtttttaaaataagtggaatttttttgtataattttgaatattaattttagggttttttaagtttattgtttttggtatatgtttgttttattttgtgtttttttattttatttttgtgtttttttttgtttattttagtatgggatatttgttgttgggttttgtaaatttatttatattaatttgggttttttaaattttatatgttgaattttaagttttttatgatatttagtagggttggaaggttggaatttttagagtatgaaaattgttttttatatttttttttaaatttggttattatatttagagtatgttgaatttttttttgaattataaatgatttgttttttgattgtttgagttttataaaatggagggatttttttagtgattttttaaagttattgagaatgttgtgggtgtgtgagttataaagttttggggtattaatgtttatggttttatatgttgtttggttatgaattaggttttttaagatgtagatagtgttatttaggtttttggagtatattgagtagttattaggaggtgtttaagtgtgatttaggattttttaggtttttttaaattatatagggttttttgggtttttttgggttatattaagtataaaaggattttttgggtagagtttatttttatttttgttatgttaggtgttgttaatggttttagtttttaaatattttgagtattttttttgtattataatatattgattattaaataattttttgggttttaggagttttataataagaattttgtttttttaaaatttaggtattggtttgaaattttaatggttaggattatattggattttttttttggttttttatatttggatgttttggatgttgttttttaggttttttaggaatatttagtattgtttttggattataggatagtattgattttttgggttttaaataatttattgagttattttaaagttaagtaatattttttttaagtatattgtatattttttattataaaatttgaaaatttttaagttttaagatttaggaattttgaattttttttttttaaaatgtatatatggatttttaagttttttaaggattttgagtaatttttttagatttttagatttaaaaatgatttttttggagtttttaaattgtggtattgttttttagttttttaaagtaaattgagatttttttttttttataaaataattgaggtttttttttttttaatattgatttatgagttttttgattttatggtttttgttttgggtttttttatatttagaaaatgttttatggatttttaaagtatattaaaaaatgtttttgggttttaagaaattttaggtatggaaaaatttgtgatttataagttttttagttattaattaggtttttagaaatttagatattaaatttttattgggtaatttttatgtgttttaaaaatttgaaatgtgttttattggggtttttttaaatgtagatgatatttaggaaaatatatagttttttttttatttattaaaaataagttaatggaaattatttaaaaattagtatagaaaaataatattgattttttatttttttattttttattttgttttttttaaatgtattgattatattttaggtttttttaaaatttagatagtgtttttttttatttttgaagggtgttaaaatttttttttgaagttatagtaattatgaaggttattttttttttggttgttgttagtgtttaggttattaatttatatttttaagatgtgaaaattaattttagtttttttttaatatattaagaatgtgtttggatttttaaaatgtgttttttgtttttatttgttaattttatgtaatatggttttatggtaaaatttttaattttatatggagaattttttttaattatttttttttataaattggttttttaagttagttggtttttatttgagatttttttttttatgtttttaattgtatggagtaattttttttattttttaaatttgtaatttatttttttggagttttgagtttagttattaattatggtttttatattaatggagtttttggggtttttttttttaggatatttatttgttaagtttgtaaggtagaaagaattttgttttgtgttttttaaaatttgggtattgtttttggtttgttggttatttattgtagtttttttaattttgtgtatagtgggtattggttttgggtttttttgttttttatgaagtttttagagtaatttggatttgggaaatttttttttagtgttgtttaaatatatttgggttggttgtgtgtttttaggatgtggatagggagggtttttttgtgtttaggaaagtgattgggtattgtttttagttttttttaaatttgggtattgtttttgggttttttaatggattgggtgttgtttttggatattgaggattggttttggggttttgtttatttttagtagtgtttattgtttgttatagagtgtttgattgtttgttgtttgagtttttggtgtgtttgtggatgtagtttttagttttgtggtgagttttttgttgtgttgattttttttgtttttgtgtttttgattggtttttggtttgtatttgttgttgttttgttggtgttggtgtttgtttttggttgttgttggggaggttggtgtggggtgtgggatatggttgtggatttgtggttggtggttgtgtttgtttttgttgggtgttttgaaatttgtgttatttttgtttgtttattgtaaagattttatttgtggggaaagtggttggagggttttaaagtggggtgggtagggggttggggtgagggatgtggaggagaggtgtttttgttgggtggtaaagtgtttttagtttgtgggtttaggattttgttgggaggtgtgtgtggagtgtgggtgaagtgattgatggtggagtgaggggggtgaggggggttaggggggtgtgagattttgttggtggttttttttttttggttaggtttaggtggtggggggttggtggggtgtgggattttgtgtgtggtttttgatttggtaaaaattatagtgtttttttatattgtttaaattttttaggagatggtttttttagatttttaaattattgtggtggtttttgagattgaatttgtgtttatgtaagtttaatgtattgaggatggggtaattattatttagatattttgggtgggttgtaaaggtgagttatttagatgtattttggtgagtttggttatgtaggtaggatttgagttgtgttttttgttttgatttttttttttttggtggttggagtttttgtaggttttaagtttggtttagatttggtttggtgtagttggttttttgtgtgttttgtatttggtgggggttttggggttttggtgtggtattggggggtgtttgggatttggttgaggttttaagtgttgtgtggttggttttttttgttggggtaggtggtggttgtgtgttttgtttgagtttaggggtttttttagttgtaataattagtaaggattttttgatttagttttaagttatttgtatttgtatttagatggggtgtatttgtagtgtagttttttggtggggtgttgggagtttgtttgtttttgtttgtttggagattttagtttatgagtataggttgtttgggtattttagaaatttgggatggggtttttgaattttttagaatgggtatttagtatggttttggtgttttgtggttttttgttttttatttagttttgtttttgtgtattttttagtttttgtgattgttgttttttttttggggttttagggtttttagtttgtattttttgttttgtttttggtttgggttgtgggggtgggttgggggtggggtgagggttttgtgggtgtttattggtgtgggtgtgaggttagtgaggtttgtgtgggttttgggttgtgggttggtgtgattataagagttgggtgtgggtgtttgtagtttgtttgttttttggtggagttgtgtgaggtttggttggttttggttttttttttttggttgtttttgttttttggtttatgtttgtttgtgttttgtttattagtgtttttattgggtaaggtggttttgtgttgatgttgtttgttgttttgttgttgatttttgttttgggtgttgtttgtggggttgtgttttgttgggtttgtggattttttgttgttttttttttatttattttaattttttttatttttgttttgtttgaggaggtggttttttttgtaggtagtttggtttgtaggttgttggtgttgttatttttttttgtgttttttttttagttttttttttggtgtgtagttttgggttgtttttttttttgtgttgtgttttggagtggttttggtgttgttattgtttgttttttttttgaggtttgggtttgtgatggtagagggttttgttggtttaaattgagttgggtgtttgtggtttgggtgtagtttttattttgttttttagttattgttttttttggttttttgatgtggtgtttttttttttgtttttttgtgttttttgtgttttttttggtgtttggttttggtttttgtttttttttttgtaattttttttttgtttttttttgttttttttagtttttagtttttgatttttttttttttttatgtttgtttttttgtttttgttgaattaaagtggattaattatatgttttttgtttttttttgtgttgtttttttttgttgtgtgtttgtttgttttttgttgtttttttttttttttgttttttttttggttttttttttttatgtttattttgttttttttattatttttgtttttttttatttttgatataatagttgattttattttttgatatttttttttttttgaaaagtataatatttggtttgttttagtttgaagatagtttgttttttttggataattagatgaattttttttttttttttaaaaaaaagttatttttttgttttgttttgttgtatatttggtttttgtgatttggttagagtggtgttggtagaggagtgtttggtaggagggttaatgtttgttgtttggtttgtgatatgtagtagggaggtgggtggtagtgttgttggtttttaggtaagtggtgtgtgtgggttgggttggggttggggttggggtggtgtgggtttgtgttggatgtttggttttttttttgtttgtttttggtttggggtttgtggggtttggtggggtggttgagtttgggggggaggaggaggaggaggaggaggatggatggttgtgggttttgttttttgtgtggagttttgtgtttattttggtggtggagttgggggtggggtgggggtgttgggaagggttgagggaggtgtgaggtgtttgtaggggtgattttttggttggtttgtgggtgtagggggtgttgttttatatgtgtgatttgtgttttgtgggttttggtttttggggtgttgggtaatgaggaggggtgtggagttgtagaagtttattttggtatgttgatgtggtgttagtgagattgtgagaggaagatgggggtgggtggggttaggatggagaggggttgagttggtaggagttatggtagatgttatatttgtgatattttttttatattttttttggttttgtttgtaatatttttaaataggagttttgggagagggggagaggggttgttggtttgaggttaagaagggtagagtttttgatttggagagaggttgtggtttttgtttagtgggtagtgtggaagtttttatataaggaggtgggaaggagattttttttttttttattgttttgtgtagagatgagttgggggtgtaggatgggagtttatggtattttgttatgggatggtttagggtttttggttgggggtgtaggagagaagagattggttgggaggagggagagggtgggagtaaaggtgtgggggagtggttagtagggagaggggtggggggtagggtggagtttgggttgggaggagttggtttatatataaaagttgaggtattgattagtttgtaaattggatattagttttttttgtgaaagagatttttagtttttttttttttttttttttttttttttttttgttttagtgagttttttgttgagttgtaggtaattagggttgtggagtgaggatttttgttgttattttattttagtttgaggtagggtagtagggggtatggtttatgtttgggttttgggttttgtagttgttagtttgttgttttttggatagtattttttttttttttttttttttgtttttgtttttatttggtttttgtttttttatttgttttttttttttttgttttttttttttggttttttttttgtttagtttaggattttttttgggtttttatttgttttgtattgttgtatgttttttgttttgttttttgttggttttttgatttggatttttaagtttagagtggtggggtttgttgtggaagtgtggtgagggttagagtggttagttggtggagtgtgtttttagaatttggaagggggtggtagagggggtggtgagaggattggttagggtttagttaaggagatgattaaggaggtttttagatttttggtgtagttgtttattagtttttagagagggtatgtaaagttgtgtttttgttttattgtttgtttagttgtttatataatttattgtattaaaaatttttttgggtttgtggagtgaaggttggggttgtttgtttggagggttttattttttgtaggggtagggttaatttgttgtggtggtttttggttttttatttttgagtgggttaatttggttttgtggttttgtagtttgtggagggggtgtgttttaagattggtttttttttttagattgtagtttggggaatttggtgttggattttttaggtggtttgagttggtttttttagtttttatggggagagtttggtagtgtaaatagggagatgttttggaggtttttggttttattggtttgatttgaggtttggaaaggaggttttgggtgtgtgtgtgtgtgtttgggggtatttaaggtagattggagttggagaattgggtgattgggaaaataaggtttttagagtatgggtggtgtggttgtgttaattattggagtttttgatttaggtttggtttagttgtagattggaaaggtggaaaagttagggggaggggtggggttggtttagtaggattggtttgttgttttgagggtgatggtttttttggattttttttgtttagttgggggttgtggggaggaagggattggtttttttggatgtatatgttttgtaggggtggggttgtttgttattttggttggtgttggaggtttgagaagtggtgatgtgatgttgggttggttttgtttttatggtgttataggatggaggttaggttgggtgtttagtttgggtttttgtagttgtggatgttgttgagtttttgtaataatgattgtggagatggttattttttgtgtaaaattattagtgttttttgtaaatggaaggaattgggttttttttgtgtgtttttggatgttttattttgtatatggttttgtgtttttattttggtattatgatttgtgtgttatttttgtaataaaaataatgtttataggaaagttgtgtttttaatttttaattgaatttgtaggttggtaaatttggtttgggaggggtatttttggtttggggtttggtttggttgttttgtttatgttattttttttttgtttttagatattaatgggaattttaatggggaagttgatgttggtgttttttatttttttggtttttgttttgtgttgtattgttgtttattgttttagtgagattttgtgtggtggggagttggtggatattttttagtttgtttgtggggattgtggtttttattttagtaagtagttgggaggggtttttttagatttggttaggtttttagagtgattggtgaggatgtttaattttaagttaggggagtatatttttaggttagtagtttagttgtttgttttgagattttgatttttttgttgtgtttttgagtatgtgtggtgttttagggtatttatattagttgttttttttattatatgttttttttgaagggtgggttagaggtgttttttagatgttaggggtatttataggggtttttttgggtattagaatttttgttgggggttgtgaggtttttgtttttgaggtattgtatgtttagtgtagggttttaggttttggaggaagagtttgtttttttttttgtattttttggatattttgataagggatgtgtgtttggtgaatgattagaattaaaattaataaagtgatttatataattaaaattaataagataagtgtagttggtgggtggtaggggtgagtggtgtatgtgtttttttgggttttaaggttgttgtggggggtgtttatttgttgattttaaggatgttttagtttttttttatgttttttttttggttttttagtttgggggttggtaggtgggtgtatggtttattgtttttgagattttatttttagataggggggttgggtggatgtagaggtaggtatggtgtttgggtatgtttgatggggtaggggaggggttgttttttattggtagaggttgtatggtttattttatttgatatttattatgtgatatttttattattattgtttatttatgttgtgaaatgggtttataggatgtaaatgtattttaaagtttttttttgaaaagtttttgttgtttgattttggaagtttttgtttgttttggttttttttgtgtttttttttttgtttgttttatttgggggtaggaagtggtattgtagggtttggtgttagttagtttttgtttagggagaagtttttttgtattaggtttttttgagaggaggggagggttaagtttttatttgggggatttttgtgatggggtttttgtttttttttttggttgatggtatttgttttttggtattttaaggtggagtttttagtgattttttttttttagttgagtattgttgtgggggagagggggaagatgggaggaaagaagggagtggttttattatgtttttttatttttttttttttgttttttttttttttgtttttgtttttttgttttagtagttttaggggtggtgtgggtttttttagttttttaggtggtgttaggttagagtttaagtttagggatagtagttttttttgtgggggtttttgaattgggtttatattttatatattttttaaattatttttattgtgagtttttggttttggtggtgtttttttggttgtgggattaagagtttgtgtttattttttatttgaggaaggaggtagtagaggttatgggttggtttgggttttatttatttttttttttattttttttttttttgggatgtttttgtttgttagtttttattttttttttttgatttgtagggtggttgtgtttttttagggtttggtttgagggtaggggtggtttgttttttttttagtttttgggggttggggttagtgtggtgttaatatggttttttttgtgttgtgggatttttaggtaggtttgtaagttgtgtgagttgttgtagttgtggtattgttgaggagtgttgtttttgtagttgtgatttggtttttttggagatgtattgtgttatttttgttaagtttgagagggatgtgttgatttttttgattgtgtttttggtgagggttttgggttttttttttattttttagagatagagaaatagggttttgggtgtttagtgttttttgtggtttttgggattttttggttagggataaggatttgtgatttttttgtttgttgtgtggtttgggagtagtttagatgttggttttttttgtttttttgtttgtggatattagtttaagttattgattagttataggggtggtttgttaggttaggtgggtggtttaggtggaagagtgtggagagtaggtatttgttgattagttttttttttttttaggataatttttttagatattttgtgggtaagtttttttaatatgatatttggaagtagtttatttagtgtttgtgtaggggtttgtttgtttttttgtgtgtttgttggggttatgtgtttgttaaggagtttgaggtgtttagggaggttaaatgttattgttttttgattgttttatttatttaagattttgtttatgggggtgtttttttagagatggttagtaattggaagtgagtaaaattgttgtaagtttgtagtttggtgttattattttgtagtttttttttgattatggatgtttttattaggttttattttgaaaattttttggttttatgtttttttggggttttttttgatttagtttttgtgttttgtttttttgaaataggttattttttttggttttttttattgggttgaggaagtatagtagtatttttaaatatgtataaaattgattggttttaaatattttttatatattttttttttaaattatttttaattatttttatatataaaaaattaaaatattaaattaattttttttttttttttttataataatttttttaaaattaattggttttttagaaatattttataaaagtttagaaattggttttaaaaaaaataattattaaaaaaaattaattggttaaaaaaaaaaagtattaaaaatgaattggttgagaaataattggtaaaataaaggaatttggtattttttatttttttttttttttttttttttggattttgagttaaattggtttggatttgagtttttgaattagtaaagagaaaagaaggattttagaaattataggtgggtatgttgttgttattgttatttttttttttatgggaatttttagggtaaattggttatttgaaaatagtaataatttagattggttttttatttttttttttattattaaaaattatagagtagttagagggatttagtaagattaaaggaggggaggatagagtatgaaaattaaaatttatgtaaatgaaatgtaattggtatgatttttatttttaaattttatattttaatttttattttaaaaagtatttatattttatgtatttttgtagttatatatatataatatatagtatatgtatgaatatagtatatatatgagtatagtatatatataaatgtatagtatatatagtatatagatgagtatatagtatatatataaatgtatagtatatatatgtatatatatgtatatatagtatataaatgtatggtatatatatgtatatatatgtatatatagtatatatataaatgtatagtatatataaatgtatagtatatatgtatatatagtatatatatgagtatatagtatataaatgtatagtatatgtatatatatgtatatatagtatatatattagtatatagtatatatataaagatatagtatatatatgtatatatagtatatatatgtgaatatagtatatatgaatatagtatatatagtatatatataaatatagtatatatatgtatatagtatatgtatatatagtatatatatgaatatagtatatagtatatatatgtatatatagtatatatgtatgtatagtatatatgaatatagtatatatataaatatatagtatatatatgtatatatagtatatatatttatgtgtagtatatatatgaatatagtttatagtatataaatatgtagtatatatgttgtatatgtaagtatttatttgtatatatatatgtgtatatatatgtatatttttataaaattggatgaaaataataagtatatttaagtaattatgatatttgtatggattaggttaaagttttgttaagattttttaatgtttttatggtttgagttttgtttttgtttttatttttattgttttttggttttgtttgtgttttgttttttagaggagggggtttagatggtgtggtttgagtgtgtggttggtggtatttgggatatatttgtagggtgggtggggtgtgttttaggtttaattttatttttttattatgatagagatgtttttgtgaggttggtttttttggtgtttgtttttatggtttttgtagtgtgagttatgatgttttttatattttatttatttttgatatattttatttattgtgtgttggtttagttagagtgaggaaggagtttggttatattggagatggtggtagttgagtagatatgtttttatgagtagtttgattttttggtgtgtttttggaaggaagattttggggatttttttattggagtatatttagggattatttttgtttgttttttggggattttttaagaaatgtggagtttttgggggttgtgtattgatgtggggagtgtgggaagtttggtggttggaggggtgggtggggggtagtgggggttgggtggggggagttttggggtaggaagtggttttgggagattttggatggaaaagttaggaggattgatagtagatttgtagaattatatagagaaattaggaatttttaaattttatgttaattgatttattttttttttttgttttttggggtatttttttttttttttttttttttgttttttttttatttttttttagttttatgtgtttagaaattaaattaaattttttttttatgtaataggggggtagtgataaaagtaagaatgtatgaagttagtttggagattattatgttttgttttttgttatttattgttttgattggattttgttttttatttgtttttgttgtttgggttgagttgagggtggagttttttggggggtattggttattgagtttttttggagaagttagaggggagtggagaaggttattgtttggtttggtttttggggatagtggttggtttttagaagttttgagggtggaggggggggttgggtagggtttttttaggtgttaggagggtgtttggaggttataggagggggtttttggttggtttgaggttggttggaggggaaggggttagtaggtgtgtaaatagagggttttattaggttggggtagggtggttgttttttgtatatttgaggaattttttttttttttttggtgatattttgtttgttttttagtattttgttttgtttttaggaggtttgaagttttgtgggattttttgggggtaaggtggggtgaggttggggagtagggaggttaggtgggtttgagtttatagagtaggagagttgttaggtttgtttattgattaggttgtttgggttttggagtttatgggtttggtgatgttatagtagttattattgtggtgtttagggttgtggtagggatttggtttttgggaggtttattttgtttttatttgtgtttttagtttagtttttttgtatgtagtttgattagtagtttagaggtttgaggtttttgggttttggtgatggggttggtatgattttgggggttgtttatgttagtttgttttagttgtagagggttttttggtaagtgttttgtgagtgggttatttggaatattggatagaagtttaaagagttaaattgttataattgtggaatttatattggtttgagatttaaaatgttttgaggtattttaaattatttgtttatttgttaggatatttatttatttagtgttatattttgttttgttggagtgggtgtttttgggggtatttgttgattagttttttgtgtttttaggtttgtagtttttttttgggttattaattattttggtttgggttgtttgtttgatttttgtgtttagttgtggttttttattttgttttttttttgtgtttttaatgtttttagtggggggtttttttttgggtttttttttttgttattatttgaagatttttatgttaaatattgaatgttatttgtgtttgttgttttggtttattttgtggtttgtgtttgatttaatttaatttttttaatgttaatatttttggtaaaattttatgtttgggttttgtttttaattttgtaatgtttgtaattttaataaagtattaaaagttatgattttttgagtgttttattttttgatttgggtattggattgttagagggagggaaggggttgagtatttggaagtaggtagagggggatagaagagggaaggggaaggaaggttttaggggtgtggatatttttttttgttttttgattatatatatggagaaatgagagagttggaagttagatttttagatttattgttgtgta

SEQ ID NO: 244 - DNA, 51912 bp, Artificial Sequence
  Chemically-Treated DNA
ttttaattattgttttaaaatttaaaaaatgttgttggttaagtaaaaatagtaatagataaaatttgttttgagtaaatagattatatattaataaatgaatatttagtttaagtgattttttatgagatttatgaagtatttttaattgaaatttaataagttataatttaatagatattttaatttttatttttagaagggaaatgtgatattttatgtagatgtagttttttaaatttagttggaagatagtgtgatagtgaagttgtgtgttgtaattttttaaaattgttgaagtgttatggtttgttattttgtatttattgaaaaaatgtaaatgttatatttaatagaatggtagtaattttgttttaatttgaagatttaattttattaattatggtaatatatgttggttggagttgggaatattttataaaatattggaataaatttgtgtttatattttaggggaattaataaaagtatttttatttgtaatatttaaaatgttattgtttttaaatttgtattaaataatgtagggaagatagattattgggggagaatggatgtatttttgtgaggattttggttatttaatatatgtgtatgggtgaggaaattaaggtatgatttattgggtagggaggtagggatattagtaagattttttatttgtttgggttttttgtttttgagttatttttgtgtagttttttattggattttataagtttttgaggtggtagggtagataggatatttttattttatagaggaggaaatttaggtttatagaggttttttgttttaaattataaaggtggagtttagatttttttagtttttattaattgtattttggttagttataattttatttatttatatttaaatggatattgtggttttgtaatttttgttaaaagggttttttggtaataggaaaaatgttatggttttattgtattgtagaggatgggaatgggtgttttggttaaatttttttttttttttttttttatagtttagatggtaaatgtgtgatttagggattttttgttttagtagatttgtgtgtataattttgtatagattatttgttaagttagagttgaaaggtaatatagatgttaaaggataataaaggtgaatgagatttatttaaaattggaaatttggtgtttggttttttaggagaataattaatgattgtgatttgaagtttattagggtattttgagagatttaattaaagatagagtgttggtttgaaattattaaaaggtaatagtaaaagggagagtaaaattttagttttaatgtaatttataaatttattttgttttttttgaaagaggggtgtgggtgggtgtgtttttttgtgagtattttatttaagggggaattttttttagtgtatggtgaagtttttttttggttgttttatttggtagtttttttaggattttggttagtttttaattggttttagtaatgtttagttggagtttttttgggtttttgagtgggagaaaagtgagagtaggtgtttttttagtggtgtgttttgttagggtttggtaggattttgtttttaagttggggaaagttggttggtgttttttttttttgatgaagttgttttagggttgtttttagaggatgtgtggtaggtaaagagaatgaatttgagtgtttatgaaatgttttgtatggtttttgggagttgggagaaataggtgtttttttttgatgtttgtgggtgatgtttgttgtattttgtttgttgttgtgttttttttgggtattttttgtttttggtgtttttgtttttgtttttagtgttagggtggaggtagttttggtttgtaggtaattattgttagtggagtttgttggggagtgggggtgggtgtgttggtggtgggtgggtgggtgtggtggggtgtgggtataaaggggtgtggtgtggggttttggagtttggtttttgtgtagtatgtttgttagtgttttgttgtgttgtttgtggttgttgttgttgttgttgttgttgttgttggtgttgttgggtttgggtggttgttgtttgtgtgtggagttgggtgatggtgtgtagatttgggtttgttttttgtggttttttgtttttgaggttgtgggttttttttagggtattttttttgatggttttttttgggttgtgggtagtgttgtttattagattgagggtggttggtagtagtatggtaagggtgtgtttatttgggatatgtttatttattattttttggtatttttgggagatttttggaatgttagtttgttgttgggtgttttgttgttgttgtagtttgttattggggatgtagttagtgatagttataataatgttttttgtgatatggaggtgttgtgtgagtttggggttatttattattgtttttttattttgtgggtgtgagtgttttttaatggtagtgtgggtgtttttaattgtgaggggttgtgttattattggtgtttgttggagtggttgtgggagttgggtgtgtagtttgtggttattttgtattattgggatttgttttagtgtttgtaggatgtttatggtggttgggttaattgtgttttggttgattattttagggattatgtggagttttgtttttgttattttggtggttaggttaagtattggattattattgataatttttatgtggtggtttggtatggttatgttattgggtgtttggtttttggtatttggggtagtttgtggtttgggtatttggtggtgtataatttttttttggtgagtgtgaggggttaggtggagggttatgtaggggagatagagggtttttataggggttagggggaagtgtgggaattgagttttttttagatgaggttttatttggatatgtgtatgtggttattgggggaaattgagtagttttgattttttttggaaggtgtggaattaggagagaaattttttagtgggtatatgagtgagtgttttttggagtttatttgtggaaaggaagtggtgataggtttttgtagtgaggaaagaaatttttttttttgggtgtagaggaatttttagaggtgagggtggggaggatttgttaggagtaattgtaggaagagaatgagtagggtggatgaaagaaatatgtttgtttttaagttgtatagatagtattattttttggagttgttatgagtttagtgttaatttaataagatttgttttgtttgtggtataagtttatattgttgtgaaagtgttaaaatataatttttggagagttagatttaaattgtgtttggaggttttttttgtggtagggtagggaattgtatttattaattttatttattggggtgtgaagattgttttatataattttaaataaagttagttatagaaatatagaaataattgtagggtgatatagattgttttattatatttatatttttatagtgttttttatagttgaaagggttttttatttatgatattgttagtttgataaaattaattgtaatatttttgtgtaaaatattttattaattttgatagtaggaaatattgttatgttatggtaaagttgttttaagtatttttttttttttttttttttttagtgtttaaatttaggtattattgttttggggatttatttataattatgttagttgttagtatattttgtatagagttttgtattataataaaatattttatgtatatgtataaatattttaataaaagtgtttaaatgtataatttttggtatttaattttgattatttgtgggtttattggaagatttatttttaaatttagaatttagttatatattttgaataaagttagtattaaaattatttttaaatatttttaattaaagttatagataatatgggtagagtagtattgggttattgaggtgatttagtgttttgagttgttggtaatgttgtaataatggttaaattagattttatgttagttttataaaatttgtttgttgttattggttataaaagaatgttggatttgtttggaaatatattgtgatttttgtgattttatatttatgtatgtttttttataaggatgttttagagtggtgatttttatatttttttaatttttttatggatttgaaaaattttaaagattattagtgtatggttggtgatagaaaaattatgggaagaatggttttattttttgaagaaaatataagtaagttattagtttatattggaagtaaataaatggattagttggaggatttaatagattatgtttataaaatttttattttagatttaaattttataagttttatttttagagtttttaggataaatttgtatatataaagtagttaattgttattatagtgatttataggattattttattataagataaagatttgtgtgttttttggtgttttggtgttttaaataattaatatgttttagatttttttgtttatttatggttttttgattaattttttagttatattttttaatgtttatataaaaaatttgttaaatattaattattttttttagaaatgtagtggattttgtatttagggaaattagtaataggtgaatgttttatttgttgatgttgtaaataaattgttagttggtgtaaagtattaattttgtttttatattttttttggtttggtgtttagttatttttgtattttatttagaagtgagtttttattgttaaagaaagtattttgaattaattttgttgtatgagatatttttattttgtttttaatgattttttttggtgtgtatataggggttgggggaagtgagaatagaaaaatttgagtttatttgaaaaagataaaatattttgtagattttgataaaagggtattttagttggggtttagatattgttgttgtatagatataggggttagttgtgttttgggatttgatgttggtgaaggataaagattggttagtattttttttttattttttttgtgtttttattaatttataaatgggttaaggagattttttgggatgatgggaagtttgattttttttagagagttaagaattattgatggtttggaggataggaggtagaataaataaatagtaggataaataatggaggttttgtttagaatggaggttttggtgttttttgtgggttttttatattggagtgagttttggtaaaaatggtgtgtgtgtgtgtgtgtgtgtgtgagagagagagagagagagagagaggagatagaagagaaggagaagaggggagaggggaggagggatagagagagagaggttttttataaagagtttggagtttaggttgttttgtttatttgagtgtaatttaggaggatgtatttttttttttggatttgaagattaattgtttagtttttatagtttttgaaataaagtttttaatgttttttgaaattagtattagggattgtagttggggagtttagttttagtagtgtttttgagtttttgttttgtatatgggttttaagaggattagaattaagttggaaatatatgtgtttttattttttatttttaattttttttattgtttgagatttttgtaaatatttgtgtaaggaatttgtgaaaaagattttttttatgtaaggaagtagggttaggagatattaatttgggtattgttgagtattagtattagtgtgtaggttttagtttatttgtttgtaatgtttgttgaagttattattttttgttttttgaatttttttttaatttggattttaggttttggtttttttttgtttttttttttagttttttggtgatttttttttagttttttttgtttgtttttttttattttgtttgtaaatagtggagggtttagggttttgtttagatttattttaggttattgttttgaatattgttgtattttgatgattggagattttgagtttttatttaggtttttttgagtattagattggtatagataattgttttttttatgtggatgtttaatgggtatgttatattgaatatattttaaattaaatttttgtttttttttttttattatgatgattttttatttttttagttgttggattttgaattttaattattttttttttttatgttttgtttttaatttattaataaattttgtagttttatttatttttaggatgtgtttagaattaaattatttttttttttatttatgattatgatggaggtgtaagatattatttaattttgtttgggtaatgggaatagttttattgttggggtttttatttttgttttgttttttgtagtgtgttatgatggatgttttatagggtgatattatgtgtggataagatagagtttttgtttttttaaattttatttgtttttttggagttagttaatatgtttttttgggttttatgtttgaatgttattttttttttttatggtattttgtataggattttgttttgtttagatgtttttttttgtgtttttttttttatttaattatttgtttttattttatttttttgttatttggggtaattttgttttttttatttgtatttttgaaaatggtattttgtttttttttggtgtttagaaggtggtttttggtttattgaatagtttgattttatttttataaatttatgttattagaattttttttttttgttagtttttttagttattttttaatggaatagagattattaaattttaatttgataaggaaaaataggtaaatataatgtggtagattttgatatttgtagtgaaaatttaaggtttattattaaatgtatgattttattgtgaaaatgtttagttaaaagttatttgtagttattatgtagtattatgaagaagtttttagaataagggtaggtggtaaagttttttggttagttttaggagtatatattggaaggggttttgttagttgattgaatttttattttttaagtaattagtatgagtgatttgtttattgtatatatgtttaaattatatatattatgtatttttgagaaatattttataagttttttttttattaaaatgtatttggggttgggtgtagtggtttatatttgtaattttagtattttgggaggttgaggtgggtggattatttgagattaggagtttgagaatagtttggttaatatggtgaaattttgtttttattaaaaatatggaaaatttattagatgtggtggtaggtgtttgtaattttagttatttgggaggttgaggtaggagaattgtttgaatatgggaggtagaggttgtagtgagttgagattgtattattgtattttattttgagtaataagagtgaaattttattttaaaaaaatgtattttgtatataattagaataattaattggattgaaagttaatataaattttagaatattattgaatttaatagtgtatttagttagaaatagttaaaatattttttaaatagtttgaattatttttttttgaatatattgttttttgaaggttatagttaagtttaagaaaaaattttaaaataggaaaagaattaattaaattattttaaaattatagtagtgttttaataatgttaattattttgagttgaagaaaagaaggaaaatgtaaattatgtatttaagtaatgttaatgtatttttttaggtgtaaaatgaatgaataattaattgtgttagttgaatatgtagtaattatggtttttgtatatagaagttttttgaattattttatatttttaaaaatattattgttttaaattagaattttattataattaatttgtgtaaaagttgttttttttttaatgaatgttgtttttttgaggtataaaggaaattttaggtggaggaggagaatagaatatatgtttattgggaggataagtaataataggtgagtaaaaatatatagtttattgaattgttttagatttatattttttttagaaatgtaaagttatatttgaaatttatatttaaatagataagtagaatgtgatttttatatgttttattttgatgtattttgagtatgaagataatttgaaggatgttttttttttttttttattttggggtaaatttttatttattttttagagatttgatttaaatatttttattttgtaataattataggtagaatggattatttatttagttgtggtttttttaagagtatagattatttattatatttattttaaaatttgtagtgtttattttagtgtttggtatagaggaaagaaatataatttttaataaaggtataagtggagaggtaaaatatatatttttggttttaatgtgtttatatttttttttgtaaatggaatattgtgtttgtagtttgtttttatataatatttgggaaggagttttaaagagtgaggaagaatagtaaagatttttttaggtagatatgttatgtgatttttgttgatttttagagtatataatattttaattttatttagtggataggaaaagagaggaagagggaaaaggtggttttttaagtgtttgatttggaagttgtatttattattgttttttgggtagaatttagttatatggttaaaaggagtttgtaaataattgttttttgaggagttgggtgtttagtgaatgattttattaagttgaaattagatgggaatagattatttaggataattagtaggttttattatattgtttaatttttaggtatattgtgagaattaaaagtattttatatatgttaatgtgttttgaaaaaatataaaaagttttataaaagtgagttataaatttattattaataataatagtaataatagtaaaatatttgagaaatggtttttttgagttgtttagaaggaattatataaatgtattagatatggtagttttatttaattatttaatttgttttttttttgaaattattttaatagtatttgattaaaaattattaaattatttttgaaataatgtatttttatataaaatatattattaaatatttttttggatttagtttggtggtaaaaagatatatattaaagtttatgattgatataattttatatattgattaaattaaagataaatattgattgaatttttgtggttttagttttaatagatttttttattaatattttttgtttgaagtatagatgttatgttatttatgaattggtattattatagtttgataaaatatttaaattgaaagtagtgatgtatattaattttaaatataatggttaagtaaatgttatttttatatttataagtgtattttatttgataattagaatgttagaattagaaggaatttggaaaattttaggttatatttttttttaggatgaattttttatagtggtttttttggggttagttagtttttgtttgattttttgaagtaggaggaatttagttttatttaagttgtttttttgatttttttttttatattgaatttgttgttgtataggatttttttgtgattgtttttttgtttttttaaattttaaagaataaagtaagttattttttgataagatattttttatatatttgaaaagatattttttatatatttgaaaagattagtatgttttgttttttttagaatttttttttttatgttaatgtttgttttaagaagatatggaggtgattggatatttagttaggaatattttttgagagtttattttgtggtaggtaggtgtaatgttgaattttgagaatatgaatgtaatttttgaataggtggttttgttttttgatgttttaggataaggtggaggagaggagaggggaaagttgatttatttttttagtggggagggtttagggttgtttgtgggatttgtttttgttttattatttattattattgttttgttgatgggtgtagaggattgaggatgagtggttggagttttttttgtgttggattttgtagagagtttagagttttggtttttaaaggaggtatatttgtagggttttttttgtgagggtttagaggatggttgtaaagttgtaggggaggatgggggtatgggaggtaagtttgttgttttgttagagttttttggggatgttgtttttttttgtttgtttttttttttttttgattttttattatgtggtttttttttttttgtttttttttttttttggtgttttaagtttttttatagagatttgtgtttttttgtttttattaggtttttatgttagttttgtataggtgtggggatagtggtaggggtgttttatttttgatttaattatatttttttagaaattgtttgtagttaaatataatttagtgtggatattgtttattaaaggtatattgtttgggttgtatgagagatttagtttttttttatttatttggtatgggttgtgagggggtttttaatttagggggtttttttatttttttttggttagagttgttatttttaagtttttgtattgttagaaaagagggataaggtaagatttttgtttttatgttatagattagtaggggagaggtaattgttaaataattatagtaaaatgtataaatgttttaagagaaataagtatttgtttaggaatttattttaagaaaggagagataggttagtgttttggggaggtagtatgggagtagttagggaaagtaatatttgtaagattagaggttggtaatttttttttgtagagggttaagttttggattttgtagattttatagtgtttgttgtaattattatatagttttgtggttgtagtatgaatgtagttatgggtaatgtgttaatgaatgggtatagttgtgttttaataaaattttatttataaaaataggtagtgggttttgttgttgggtttggtttgttgggtatataaagtgagaagggtattgtgtttttttaggaaatattttttgtaaagttagtataggtgagatagtgtggttatttttattatagtatgaggttttttgaatggttgaagtgttaggtgggaaaggatgaggagttgaagaagaaagtttgggaatttttaaggttttttttaatatttgttgtgtagaattaagtagtgttttaggtgtttagagtaggttttagtgattatattttttgttagatattgaattttgtttatgttgtttaagattgtattaataattttggttgttattttattgtggatttaaattagtttgtagttagttaaaattttttaggttttttttttttagtttgtgaattgttgtgaagttaaatatttttgttatttttttggtagtttatttttaaatttttaattttattaaattttatttttaatgtgtaaagataagaggaagtttattgttgatggtggtttattttttaaaattggatattagttaaatgtgttaaggtaatttgttagaggaatgttggtatgtttatatagtggaatattaattggttattaaaatgttgatgtatgattattaaaaggtagtttatgttatgttttttttgtatgaataagtatgtaaaaagtatgtaaagattattgtatagtttatgggtgggattgggttttttttagtttttgttttttattttttttgttagtgtttttttttttgtagtgttttttttttggttgtatatttaagattggatttgtttagttaaattttattaatttatagaagtaagaggaaaaaaataaatttttattagtttaattttttaaattgggggtggtttattttatagtaataggtaattgatgtaaaaggaaaggaaataatgaagtaattttagaaaattttttatagttggaggatatgtatttttatattgaatgggaagaatggggtgggggggttatatttttgtgttattgtagggttttggtttttagggatttaggtatttttttagttagtgaattatagtttggaaaattggttaagttggggaattgtataaggggttattattttttatgtagttatgttttatgaattatttttataattttttggtttttggtagttaagtattatttattatttggtttttgtaattttaatttttgattatttttgtgggtggtaataagtttagttttgtgatatttttgttattagtagttttggtttggagagtggtgtttttattgaatgttttagtgagattggtatttttatgagtatatttttgagggtgtagtgaatgttttttttttttatttgggatttttgggaaatattgttttttggtgggttgtttgattttatataatatattggtttttgtatgttagtttttttttgttttttgatttttttattagttgttagggtaataatgttaggtatttttgtttgtttagtattgggtatttttttttataggttttttagagttattttagtagtaattttattgtgttttttggggtttttgttggattgtgaaaatatatttttggagaaagtgttttttagataatgaattattttttgttttgtgttaagttttagttttttggttaaggattttagtgttattttttaggatttgtagtgtatgtttaattttgaagtaatgttgggatatagtatttttttttttttattaggtttagttgtttttaggtgggttatattaggatttaatttttgttagtgttgggttagtttttgaggggtgtatttgttgttttttagggatgaggtttttttagtataaagaagtgttattttttattagggaagaatgggttatttttgtaagttttaaatatttttaggtttttttaattggggttttgattttggtataattgatttgttttggttgagtatttaaatatttttaaatttttgtaagtttattaggttttaggtttgttgttaagtttttttatttttttattgtaggagagaaggttgtggtttttatattgagtttttaattgtttgttattggtttttagttttttattagttttttgtagagttttaatataatatattagaaagtatttaattttatttttttgtaggtagggaatgtttaaattattgtatttataatgatattttttattaggatattttttaggttattgttgttgaaatatttagtaattgaagtattatttgtgtaaggggattatttgtttttatataatatttagaatggtattttttttgttttttagaaagtgaatgagttggttttttaattttttttgtgttagtttgagttttgaaagaagtaaatgttaagataggattagatgtataagaaatttattggggaaagaattgtgaaggataaaggggaaggagttaggggaggtattgaatttttggattatgatgtgtgtttaataattatgaaggagagtgggtagggagaaggatgggttgggaagagttttagttggtattgtgggttttagaataatttaggtataggttgatggggatgttttgagttaatgttgtttattggtggagtttatattttgttgaaatgggtttgtattagtttttttgttatgtttagttatttgggagtagttgatgagaattatgattttaggattaattgtaatggtagatttaaaggggtagtaattgatggttttagttaattgtgttttttatagtaggaatattgagtagtgtattttttggttattataaagattagtgaggagtgttttttagagaagggaatgaaaattatttttagtttagaatttgatatttatttaaattgttaattatttatgagagttaaagttttaaaaaataaattttttataaatttttttttaggaagttattggagggtaattgttatataatatgaggaagataaggaggaagatatgggatttatgaaagggtaggtttaatttaggaaaaggatgatgaattgtagatttatgatgttagatgtgtagtagattaagattagttagtgtagaatgggggagattttagaagtgtgtttttttaaaatattggaggtttatgtgatttttttggggaagtttttgttgagaggttattggaaattgagggaagaattagttatagttttaaagaaaatagagttaattaaaaagtaatgtaattatgaattttaaagaaaataaaaataagaaggaaaatagttttatttattatattataaggtttagttgtgaatgatatttatgttggtagaataatgttaatattaaatgttggttaaatttaaaattattgtataattaaattgtttgtgtaagagagttaaatttttatttagtataataggaagttagtggatattttttgaagtgtggatgtgtggagatgtaaattttaaaagaaaatgttttaagagttaaaagtggttgtttttagagagaattgggggaattgtagggtaatgtaggatagggaattgtgattttttttgtaagttgttttgatattttaaattatgaatatatattatttgtatttttaattttaaaaagatataaatattttttttattattttaaatattaattttgttagttatagtatatatttatagtattatattttgtagagtttttttggatttaagttttggagaatttttaaagttttagattaatgtttttgtgagtttttatttttttgatgataataagttataaagaaatagggttatgaataaattttgtgggatattgttagttatttttttttaagttgatttgttttatgaattaatgttttaaatattgattagtatttgatatttaataagtaatgagtaagtttttgttgaattaatgaatatttttaaaatatatttttttaagtggtaatagtattattttatttgtattttatttttttttttgattttaagaatgttataaaaatgtttagtaattgttaagattattatatatagagatgattattgtgtttttagatatgttgtatgttttagtttattttgtatagttataagagtagttgagattaggttatttatttatttatttatttattttttgagatggagttttgttgtgttgtttaggttggagtgtagtggtataattttggtttattttaagttttgttttttaggtttatgttatttttttgttttagttttttgagtagttgggattataggtatttgttgttatgtttggttaattttttgtatttttagtagagatggggttttattgtgttagttgggatggttttgattttttgattttgtgatttatttattttggttttttaaagtgttgggattataggtgtgagttattgtgtttggttttattttttttttttttaaaggaatttatttttttatagttttgttggttgggaagtttaagggtaagtttttggtatttggtgagagattttttgttgtttttttttatggtggaaggtgagagggtaagagagagataaaaggaggttgaatttatttttttataaggaatttatgtttgagatattgaatttatttttatgataatagtattaatttattgatgaggatagagattttattgtttaattggtttaaagtgagattttttaaaggttttgtttaatattattataatggtaattaaattttaatatgagttttggaggggtaagtatttaaattatagtattatataatataataaaaattttttgagttaagtttggtaaatttattttaggaatttatgttgttttttagttatttttttttttatagtattgatgtatttttgttaattattatttaattttgtttgagtttattatttttgaaatttatattatttttttttttaaagttgagaaaatttttattttttaagtgttttattttttataattttttaaagtaattgatggttgttgtatgattataagtgtaaattattttgttagattatatttggagatgatgaatttggaatggtatgtagatttttgatattaggagttttgttttttgtaataattaggaatttaggtttaaaagggagtaggtataatagaagggtaaggggtgataatgttggtgaaagatatttgaggaaagttattaatatgaaatagaataaaataaatagaaaagtaaattagggaaaataaattatgtaggaattaaatatatatataaattgaaataggaattattagaatatataaaaaatttttgaatattagtaatataatagttgaaataaaatatttagtaaaatatttgaaaagtaaggttaaagtaatgttgtaaaagtagtataagatgataaagaaatagaatatatttttgaaagggaaaaagatttaaaggatatttataaagatttaatattagattaatagaagttttggaaagagagaataaggaaatataggttaggaaatttgtaaagaaataatataataaaatgttttagaattgaagaatatgagtttttaattttaaagagttgattgagtttttagtttaatgaatgtatagatatgtaagggtattgaaagtttatttttagtgttatgttttttaagaagttaatggaagatatgtattagtaaaattgtagtaaatatataggaagaaatagtatatagaaaaagtatggttttaatttataagaaataaaggaaatttttaggatgagagtagtttttgatagtatttagtttaaattggatttggaggttggaaatttttagtagggaaggaagagttttgggtgaaaaagtagatttaatagaatagatatgattatagaaaatatgatagagaattattaatatattgaaaaaattatatatagaatattttgtatgtttaataatgaggttattatttatttaagggaaaattaaaagttgtttagaaaagggaaatgttatagtgttttatttggttttaaaatgaatatttatataggaatttttatgtaaatattaataatgatttaaataagaatagatattttggaaaataagggaagaaaatggggtatgtaaaagagttaattttttattattttaatgaattattaaattttataatagtatagtatttagaaatatgatagttattatgagaagaaagagttaaaaggttgttagtggggagtaggagtgagggttagagatgggattgggggagatgtttattgtttttatgataagtttttggtattatttgattttaaattatataaatgtatttattaatttaaagtaatttaaaaaatttatattattggataatgtttgataatttttagagttttttttttttgtattttggggtaggtaaatttattgagagatttagagagtttagttgatttttttgtgggtattaagggttagagttggggttaaaatttaggttttttgaatttttatttttagtgtatattttatgattttaggttgttttttgtattgtataggttatatttaggggtgtgttagtaaatgtttagattatttttgtttatattagtatttgaaatggataagaatgttagttatgatttgttattaatgtttttaattttaattgatatttgagagtgttattattatattattataaaaatattaatttagatatatttgtttttattattatttttgtgtaatttttttagatttaattgttttaaataattattttatttggtttataaatttatgggttaggattaggggagggtttatttatgtagtttttttttggtttgtagttatttgaagtttgaatggggtggggtatgtaagatggtttatatatgtgatttgtggttgagtttggttgtggattagagtatttttgttggttttgtttatataagtggttttagattagtagtttttgtatatggaaattagttttttttttggtaagtattttaagagaattaggaggaagtggtatggatttttttttttttttttttttttttttttatttatttttgatattatgtagttttatttttattagagtagttatatgtttatagatttaagggggagggtttatagatttgttaatgggaggaatagttaggttatattgtaaaagattatggggtatgggagatatttatttattttttgtaaaaaatatattttgttatagtattattggttttttagtttatagtgatttgtttggaatgtttttttttgtttttttaggatttatattttttaatataaggtttagaaattattttttataggaagatttttttgattttttttagtaagaaagaattttttttttttttgaattgttattgtattaaaaaaaaaatttattttttggtgtttttatttttagatttatattgtaattattttatgtatttatgtttgattttttatgatgtttagtataataatttgtttattgagtaaatatttgtttaatgaaataattattatatgataatttaaatagtagttttgaaaaagtgtattttaatttagattttttttttttttttttttataatttttatttttgaaaaatgaaagaagttagaggattttttatgaggagttatagtataatttatgtgtggttgttttttgtgtttattgttatttagtgagaaatatgggagatgggagagtgaaaaattatgttatttataatttgattaaaaagttttttattttttttttttatgtttaagttttgttgttttaaaaattttttttttgttataggggattaagtagtagttaatgttgtagttttttgttttggaaatatttttaaaggtgttttaatatattttgttttaattttgatttttgttttgttgttttatgttatttagttatattgaaggttttgtatttgtgttttggggtattatttttttttatttttttttttgtttggaaggttttttttaatttgttttattgttatagttatagaattaattttttattttttttaagtttatggttataagtttttttttaaaggaggtatatttttaattatttttatttggtgattttttgttttttggaggtttttggaattagttttttttatttttagtaatttattttatgagtagtggagaagattgattatttttgggggttttgaggagataggaagttattaaatttataggtgttgtggatgaaattgtgtgataatgaatttattgggtttgtttttttagtttttgaatagaagaattaataagattatttttttaaaaaagataaaaatagataaatataaattttttagtataaaagtatttttttttaaaaaagatgaatatatatttttagattgtttttttttgaaaaggtaatttgagattttttatgaaatttttagatagaagttgtttttttgaatttaatatgttgtatattgtagagttaagaggtttatagagtgttaattaatattttttgttaaatatttgtaaatgaatttggttaaagtttaaggaaattaggtttttttgtgtgataaaatataatttttggagattatttatgattataaagggagattgtatagaaaatttttttagatttggaaatgaggtaggattattggtgtttatttggattgaggttttaggtaggtttgtttagttaattttatttttttatttttattttttgggggtgaagaaggtagtgtatttttgtttaatttgttgtttattatggattagggtattttaaattttgtaagggtagtttttaatttgtagaaaattgatagtgatgggaaggatttttgtttaatagggatataaatggattttgttttgtagagatgtaaatgaaaagatgaaaattataatatatttaatgaaaggaaaataaagatttttgtgagtgttattaaaaaaaaaaataaataaaatgtattttttttttgtggtattttaggttttttttattttattttatttttttatagtatttattgttttagaatattttttataatttatatttattatgtttgttgttggttgttgttttttttgttaaaatggaatttttgtgagggtatgggtttttttttgatttgttttttgttgtgttttaaagtgttagaattatgttaggtatataatagatgtttaataaatatttttggaatgaaaatttttttttatttagattagtgagttttaaatttttttgattttgatttatagtaagaaaggtattttttatgttgaatatatattattgaaataaaatttttatagaaaaaatttattattattataggtagtgtattgtgatattttttaattttttttattttgatttttaaaattgttgaggttatttataggttgattttataagtggagtttgtgttatgaaaaattttgatttaatattatgttgaaattgttattataaaaaggtaaatgtgaaagaagggggaaagagtaggttgatgattttttgttatttattattttataaagtatattttatttttttgtaattgtattttgtttaatgatgtagaaatttttatatatttatatgttattttttttttgggtgaaaagtgttttttattgtaagatgaattgagttattttaaaagtaaagagttataaatgagtttgttaaagaaagttttaaggagagtttgttggtatttgttgttgataatttaaagtaggagaattagataaggaggtagaagtagaatgtttagaaaataaaagtgattattatagaggaaaaattgtttgttttagttttgttgatattggagagtagtttttttatgagggtattgtggaattattggtaattatattaatagatgtttattgaaaaaattttatttgattgatgaattatggaatatttttgttgattttgtggaaaatattatttatttgagttttttatttttttgtttttttttttttatttagtttatgtttttttatttgtttttttatggtttttattttgttgttattagaaaaatagagatataaaaattaggaattggaatttttttgtgtttttagtaataattttgtgattaatgggttagatggattttggttataagttggatattttgttaataatttagtgttaatgatttggaatgatttttattgtagtatgatttagtattgaatagaatgatttaattaatgttaattagttttgtatagataaattaatgaagtaagaagtttaatttttgatttattgatgtatttatttagtgtaagttatgaaattttttttattttatttgaaggaagtttttatttaaatataaataaataagttttttattgttatttattttggaaaagtttagataaaataattttaagtaataaaattttaaaattataatatgatttttaaaaattattttgatttttgttttgtttggttgttatagtgtatttttaattaaatggatttttatagaattttaagtttggttatatttgtattaaggaattttatatttgtatttgattagttttaattaaaataagtttaaggaagaaaagggattttatgataaggataaaggattgaagaagaattttagggattttagatgttaataattgtatttgttattaaagtaattattattgttaaggtgggtttttttttttttttattaaatatatgtatatatattatatatatatatatatattatatatatattatatatatgtatatatattatatatatattatattatatatatagaaatatatatagatatatatatatgtatttatgtttgggttagtttggtttttattattttagagagtttttttttatgttagtaattttagatttatttttttttttaatataggatagttatatgtttttattttagtaaaataattttagggaaggtattttattggtttggtttgggttatttaatttgaagtataagaagagaaaatagtatttttttatttttatagattttttgtaaaattagtggataatggtaaaaattttatgatagtaggtgttttattttatttatgtttattatttttagaatttagtatgatagtttataataaatgtttattaaaataattattaaattgtatatttaaaaattaaaagagtaaattttaagttgtgtatgttttattatagtaaaataaaataaaataaatttattattgattttattgtttattttttaaaagtagtatatgttataattttatgtgatttttaaaggagatttaattttaaatttagtttttagagtaaaataaaaggttttggtaattatatatagtagtagattttattttgaagatttaataaaggtttgaaagtaaaatgttatgatattgaatatattaatgtttgagggtttgtgaaaaggttttaatataggaattatatatttttttttagattgtgttttggggaatattgggggttagtttttttattagtgttagtatgtagtaagtaatggtatatatttaagtttgagattttgtttatttttgtatttttagtatttatatatttaatatataataggtgttggataatatttgttgaataaatgattaaataaatgttttggtatgagaattatgttatttataaaattgttatttttaaaaaaaataataaagatttttgaatttgtagatttagttagaaagtaagaaatatttttatttttttagattgatttattttttggtttagttgtgtattatgtatgagttgttaattttaatattttattttttaatgtttaggtttagtgagttataatgtgatgtagattgattgaattaaaggttttaatgttgttttttttttattgtatttatgttttttgttatgtaattttgtagtgttttttattttaggtgtttatttagtttattttttgattttggttttttttttttttgattttggttttatttatgtgatttattttagttaataattataatgttggtaaatattgagaaaatgtttattagtgtttgtttagttttttgtttttttgtaattgttatgagaaaatgtttaagttagtatattggaggatgagatatgtggggtagaagtaatttgttttatttgttttagttaatattattttagattaattagatgagattagagtagaagatatgtttagtggagtttaatttagtttatgaataatatttttttatgagtatgtgagtaatgtgtaattaatgtattatgttttttttattttgtatttttaaatattttttagattgttttgttgttttgttttttagtagttattatttttgtttagaattttaattgtatttgtattttggtagtattttgttaattttttatatttagttgtttatattttaatgtattttgtaatggatgattttgagtatatgattgattattattgttttagaaatttatgttaatttattgtgatttattttgttaaatttaaataattttatatttaaaattttttatattttggttttatattgtttattgtaattttattttttaaaagttataaattattaattttgtagtttaattaggttgatattattatttttataatatgttgggtaaatttttatatttgtttttttaattatagtttttatgtttagatattttattgttttttttaagtattagttagagtttattatggggggatattttaaaggttttttttttttaatttatttgttttagaggtggtataggttagaaaagatagtttaattatttggtttaattatttggattttatagtttttttgggagagttttagatgatttgatgaaatgtaatatggttaaaaatattttggtggagaataatttaattaattagattatttggtgaaaaataaattttagttattagattttttagtattaataattttggtatgttaggaatttttaaaatatttttaataaatttttttagaaattagaatgattgaaaggtataataataggaaattaggaaattaataagtaattattgaaaagtgagtgattgaattagttggaataatttatgttatttattttgtgggggaaaaaatgaaaatagttaaataagtagagtagatattattaatttagaaaaataatatagtaaataatttgaattagaaaattttttaaaattgaaaattttagttttaaaaaatttgtgtttttttatttaaaaagtaatatatattttgttatataaaagttagaaaattagagaagtagaagaatataataaatgtttattgttttatttaatagagattataattgttatttttgtataaattttttaaaattttgttttatgtgtatttattttatatttgtatatatgattttaaaattaggtaatattgtatgtggtttatttatagttaattatagtttgtaatttaataagttatatttgtttatggtgattatttattgtttataaaattaataaattataatttatttattaatattgattatttgttgttaataatttattttatttaatgttttatttttgggttattttaattaatttttattgttagttttttaggttgttttaattaatttaagaattataaatggtttatagtagttatttaataaatatttgagtgaaaggataaatgaatgaataattttatattattggatgtttaagttgtttttatttaattttattgttgtgggggagtataatataattttggtgaagagttattaatttaggaagaattatgaagaagtatgttatttatttttgtttgtgggtggggtgtattgggaaaggaatgtttaaatgtatgtggggagttaaataagattttataggggagatgggaattgagttaaatttggaagaagtgagaatttttagttgataattggggaagatagtattaagagtaagtggggtttattaggaattattttttagaagaggtaagtttagaatagaaggtagaaagggatatggatatgaaggaaaagtagaatgtaattttagggttagtaggttggtatttaatgtaggtatagttttggatgaggagtaatgagaaattgatttggttgtagtaaaatagttaggttgggaagtgatgttgtttatatttatatgtgattttattggtttttttgttattttgtagaagattgtaaggtttggtgtttagagttagaaatgtaatttatttgatttgttaagaagtttaaagtaggtaggggtgttaagttgttgtttgtttatatatatttgtttaattgggtgttagggaaagtagatatgagtttttttgtattggttaaattttgagtaatttttaaggaattgtatatagagattattggttattttttgtggataaagttgtagatagttatttttgggaaattatttatgtgttttattaggtggttgttttgtgggaggttgtttgaaattttgttttaaggaattgtagtttataaattatagtgttgatagaaataagagaaataatttggtttgtgagtataaatattaggttagttggtatgtttatgtaaatattatatagtagtagtgatttttaaggaagtttttagataatgtaattttaatattttttttgaagttgaggtaatagggtgttagaaagaaaaagaaaataaatttttagtgttttttaaaatttttttaattttttgatttttttgaaaatggttatttttaatttagaattaaagtaatatttggagggttttttttttagatagggagaagatataaatgagttatttgaattattttttgtttatgggttgtattttattttttttattattggttttagtttatttaattaagattatttgtaggattaaattaattttttaagaattattttattttaatttttaaaaaatttaatgaatgatagataataaaaagtggtttatttagtattatttttgaaatatatttgggtgattggtgatattatttatgtttttttaattttagttttatatatttagttgagtattaggtatttttattgaaagttagatttgtgatttaaatagaatttgatttttttttttttttaattttttattttttgttttttttgagttttttgatttttttttttttttttatatgtaatatgtaatatttaatttattagtaggttttatagattttgtttttaataatagtttaaatttagttatttgttattattttttttggtttaaattattatgattttttgtttggattattgtaatagttgtttaattggtatttttgtttttattttgtttttttagattttattttttatgtagtagttattgatttttggaaatttattaattattatttagatataatgagtatatttatatagttgtttgattttatttatataaagttttataattattttatgtattgggaattataatagtggttttttatgttgagaattgattaagagttataaggaaataaggagtaatattttattgtattaatagattatattgtttatatatttttttgtaaatggatatttatgttgtttttagtttttttgttattgtgattaaagttattaggttggtgttaaagtaattgtagtttttgttattattttttaaatggtaaaaattgtaattattttggtattaatttaatattgtaagtatttttgaatttattaattaaatattattataatatttgaataagaaatatttttatagtatttataattttaagtgttttttatgtattgatttagttaatttttataaggatataattatgaggtgttattattatttttattttatagatgaggaaatagaggtatagattttagataatttgtttaaggttttatagttaataagggggtagaattaggaaagtttggttgagtttatgtttttattatttgtttaattttgtttggaatgttttttttgtattttttattgtttttgtttaattttttgggttttttgttttttttatatatttttattttaggttttagttttttttagtattttttattttttttgttatagatttttagataatgtttttttgaagaagatttgtttgtttaaattgtttttttattttaatttttgttattttttattttttttttgttttgtttttatttgttattttttttttttttaagaatgtaagttttataagaataggattatattttgaattttttagaaaagtgtttagtgtaatatttgttgaatgaatatgatttttgtaattaaaagttaaatatatatatttttttaattaatagattattgtagtagttttaaagatgaatttatgttttggagaaaattagtatttttttgttatataaattgtaggtaattatatttttatatttgaatagttttgttaatgattaagatattaatttattatatatttattaatttatagatttttaaaattgatgtatatgttttataagtaatttgatgaattttgatgattatatatatttgtatgtgtatggatatttgtaataaatatttaagtaaagatatagaatatttttattattttagaaagtttttttgtgatttttaattaatttttatttttgtaggaaattgttgttgtgatttttattattatagattgattttgggattttatgtaaatggaattaaataattttgtgaatgtattttgtgtttgagtttttttaatttatataatttttttgatattaatttatattattgtttagaagagtagtttattttttgtattaatgaatagtattttattgtataaataaattatattgtttatatatttttttgtgaatggatatttgtgttgtttttagttttttgttattgtgatttaagttattataagtatttttttttaattgtgatggggttttgtttttgttttttaggttggagtgtagtggtagtgattttagtttattgtagtttttgttatgtgggtttaagtgatttttttgttttagttttttgagtatttgggattataggtatgtgttattatatttggttaagttttgtatttttagtagagatggggttttattatgttggttaggttggttttgaagttttgattttaggtgatttatttattttggttttttaaagtgttgggattatagttttgagttattgtgtttggttagtatttttgaatatattaatttgtaagttttattttaatattgtataagttttttggggggtttatgttgttattttttttggtaaatatttaggtatgaatttgttagattatagagaaaatttatttttaattttataagaaattgttaaatagttttttaaagtggtggtattatttatatttttattattaatgtatgaaatttttgttgttttatgtttttgttagaatttgttggtagtttttttttttttttgaggtagtattttattgtgttgtttaggtatataatggtgtgattttggtttattgtaatttttgttttttaggtttaagggatttttatgttttagtattttaagtagttgggattatagaggtgtgttattatatttagttaatttttgtatttttagtagagatggggttttattatgttgtttaagttggttttgaatttttggttttaagtgatttgtttgttttagttttttaaattgttgggattataggtgtgagttattgtatttagtttgttgttagtatttttagttgtaggtattttagtgggtgtgagtgtttgttggggttttaatttgtatttttttgatagtgttgatgttgaggatatttttatgtgtttattgagtattggtgaagatttttttgtgaaatatttatttaaatattttgtttatggtgggaaggggagttattttttttttattattgataggtaggtttatgtatttattttggatataattattttgttaattatatattaattataaataaaaattgataaattggatgatgttaaaattaaaatttgtttattaaatgttagtgaaatgtaaaggtaaattatatattgaggggagatattttaatatatgtatatttatatagtgttttttgtgttttaagaagtatttttttattttaagataaagagattatttttttatattttgttttataagttttatagttttagtttttagttttggatttatgatttgttttaaatttttatgtaagattggggtttaatttttttatatatttttttagttgttaaggattatttgttgaaatgttttttttgttgttatataattgttttgatgtatttgttagaaattagttggttgtgggtttattttggaattttttgttttgtttttttgatgtatttgtttatttttatgttaatattattttatattaaataattatagttttataataagttttgaaattaggtaatgtgaatgttttaattgtgttttttttttttttagttattttagttgttttatgtttttattgtatatattttagaattaatttatttatttttataaaaagtttattgggattttggatgagatggtgttgatttagtaggttaatttggggaaatttgataataatattgatttttttaatttatgaaaatggtattttattttttatttatatattttttaatttttgttagtaatgtgttataattgtagtaaatttgtatattttttgttaaattattttttaagtattttatgattttggtattattgtaagtggtattgtatttaaaatttattttttgtttgttttttgtttatatataaatgtaattgatttttttttttttttttttttttttttttttttgagatagaggtttattttgttatttaggttggagtgtagtggtgtgattagtatttattgtagatttgaatttttgggttgaagggagttttttattttagttttttaagtagttgggattatgggtgtgagttagtgtttttggttaaatgtagttgatttttgtattgatattgtattttgttaatttgttaaattaatttatttgttttaatagtttttttgtttttttaaaaattttaggatttttatatagataattatgtttttaatgaataataaagtttgtttttttgtttgtttgtttttttttttttaattaatatgttttttatgtttttatttgttttattgtattggttaggatttttagtataattttaatagtaatggtgagagtgtttaaatgtatttttgtgtatattttatttttttggaatttattataaatggaattgtttttttaattttttttttggattgtttattgttattgtatagaaatataattgattattgtgtgttgattttgtattttgtaattttgttgaaattgtttattttttgtaatagatttttgtgaattttttaggattttttatatgtagaattatgttatttgtgaatagggatagttttattttttttttaatttggatagtttttttttttttaattgttttggtaagaatttttagtataatgttagagagtaatagtgaaagtaggtattttttttttaattttgatgttaggggtgaagtttttagttttttattgtaatgttggttgtggatttttataattttttgtttgtttgtttttttgtttgagatggagttttttttgttgtttgggttggagtgtagtggtgtgattttggtttattataatttttgttttttgggtttaagtgatttttttgttttagtttttagagtagttgggattataggtgtttgttattatattgattaattttgtatttttagtagagatggggttttttgatgttggttaggttgtttttgaatttttgattttagatgatttgtttgttttggttttttaaagtgttgggattataggtatgagttattatgtttggtttataaatgttttttttaattatattaaggaagtttttttttagttgtagttttttgagtgtttttattatgaaagatttttagatttttgtaaaatgttttttttgtgttaattgagataattatatgggttttttttttttttattttattgatgtaatgtattataatgattttttttaatgtttatttatttttgtatttttggaataaatattagttgattgtgttgtataatttttaaaatatgttgttggatttgttttgttagtatttggttgtatttttttgtatttatatttataagggatattgatttgtaattattatttttttgtggtggttttatttggttttggtattaagataatgttggttatattggttaagttagaaagtgtttttttttttattttttgaagagtttgaaaagagttgtgttaatttttttttaaatatttggtataatttattattaaagttattagttttgggttttttttagtttgaaagtttttgattattaatttaattttttttatatttagattagattttgtattttttttttagttatttttggtaatgtgtgtgtttttgggaatttggttaggttatttttgttatttaatttgttggtatttaaatgtttataatgtttttttgtaattttttttattatagaaatgatatatagaaaaggttagttattatttttttttatgattgtattaatttgttttttttttttttttttttttagttagttttgttaaaggttggtttgttttgttgattttttttaaagaattaatttttgattttgttgattttataatttttttgttttgtattttgtgtatatttattttaatttttattagtttttttattttgttagttgtgagtttagttggttttttttttttatttttttaaggtggaagattaagttattgagatatattttgtttttttttttgatgtaggtatttaaagttataaaattttttttgagtattgtttttgttgtaatttataagtattggtatgttatatatttagttagttttttatatatatatttaagtttttgttaatttattttgtgatttttttattgatttattgtttgtttgagtgtgttaataatttttatgtatttgtgaatattttagttttttttttgttattgatttttagttttattttattgtggtaagaaataatattttttatgattttaatagtttaaaatttattaagatttattttttggtttaatatatgatttattttggaaaatgtattatgtgtatttgagaaaaatgtatattttgatttttttaggtgggtggtatgttttattaatatatatgtttgttagttttaggtgaattatagtgatgtttaaagtttttattttgttattaatataattatgttagatttttaatgttgtttatttgtataatatgtttttttttatttttttttttttatatgattattttatatttatagtatattttttgtatatagaatgtaattgaaatttatttttttaaaatttatttttttttttttttttttgagatggagttttgttttgttgtttaggttggagtgtagtggtataattttggtttattgtaatttttgttttttgggtttaagtaatttttttgttttagttttttgagtagttgggattataggtatttgtatttttagtagagatggggttttattatgttggttaggttggttttgaatttttgattttgtgatttatttgttttggttttttaaagtgttgggattataggtgtgagttattgtatttagtttttaaaatttgtttttatagtatttgttttgtatttggaatatttagtttatgtgtatttgaatatttattgatatgtttgggtttatgtttataattttgttatttgttttttttttgttttatgtgttttttgttttttatttttgtattttttggaaaaattagattttttggtaatttattttttttattttattggttttttagagaaattttttaatatttttgtgagttttagggattatattatttatttttattattattttatttagaattaatattgttaattttatttaaaaatttgtttattttgttttttagttttagaatttttatgttttttttagttgttgtttttttgttgttattttttatttgtttattatatttattttttttttgaaatttttaaaaatatttataatagttattttaaagttttttgttaattttaatgtttgggatattttggtttttgttgatattgaatatttttttttttttttttaattaagggttttatttttttgtttttttatatatttagtagatttttattatgttttgtgtgttatgaatgagatattataggaagtttggttaatattgtttttttttaaagggtgttgtatttagttttgttaagaagttaaattattagatttatttgatgtggttttagtttttgttagagttggtttatttttgttttgtttttattttttaggtaatgatttttttgagttttagttggatgtttgaagtgtttagttgtatttttttattttggttattttgaaatgtaatattttttagatttatttaatttttggtatttattttttagatttgtggttgtttttttttgttgagttttataaaattttgttttgtgtatggatagttaaggatttttgggaaattttatgtagatttttaggttttttttttgtgtagattttttttttttagtatgttgatttgttttagagtttttattattgttttttttttttttagtttagtaatattgttgtgtattgtgtgggttttatttgttttagttatatttagaatataatttaaggtagaaagttggagtggatttgaggtttattatttgtttttttttatttattatttaaaagtagtttatttgtgtgaaattttttgttgggttttgtgggggatatgtataggtaaatgatagggagtttataatttagttaaagagaaaatgtttatatgttttgtggaatttagagtattttttttgatttttaaaattattttttttgatttttaaaatttggggttattagttagttggtaggaaggaattttagatttattttttttttagattttttttagattttatgttttaaaatttagatggaaggtaagaaggaagtaaggagggtattatatatgagagagatttatattttaaagtggattattagtatattatgagataatatggtattatttttagaggtttgttatataaaattttttttaatttattttttaatggtatgtgtttgaaagttttttgttttttatgattttgaaagtaaaataagaattagagtagtttatgagagagtttttttgttttagtttagaaaaatgttgtttttgttttagattttttgatttggtttttagtgttagtttttatttttttagatttgtttattgaatattggttttgttgtagagattttgttagaatttgagagataaaagatttaatgtttttaaaatatttataatttagatatttaaataaatgtaataatatatggttaaggttttggatagaggattattatagaaatatatagaatagatatttagtttatgttagggagagggaagatgttaaggaatgttttttggaggtggtgatatttaagttgagttttaaagtgggtgtaagagtgaaggaattgggaataggtaaaatatattttagagagttgtatttttaaagtatggaaggttagataattttagaattttaagtggggtttaatgtgtttgggatttggattttaggtagagattatagggtaagttggagaataggtgggtagggtgagatgaagtagagatttttaataattattaaataggtttgttatttaattgttattagttattttttttttttgaattttatttttttaatttttagagtaatatatgtttatggtaggaaatgaaaaaaatatatagatgggtaaaatgaagtgaattatattatttataattttgttgtaaaataggttttaataagttataaatttttttagattaaagtgttattaaattttatttgttattttataatttttttttgtttagagtattttagaaatgtttttatatgttaattgatatttttttgtattattttgaataatggtatttttttagttatattattatgtattaaaatatttatatatggtaaatatatttgaatattagatattttaattgtttttaatgtttggttattaaaaatagtatttagatgaatgtttttggttatatagttaataattttattgagtttttgttaataattttattaaattttaattttaagataataagtttataagattaatatattaggaataattagaaagtattgtaagattatatgtaattatttttttgttaattatttttatttgttgtaatattttaaatagtgatttttttatattttgttttataatatttaatttgttaaatgtattatttgtaaagggagtgaattggtttgtgaagaggtggtgaagttggtttaatttagtttaatagataatgagggtttttgtgtgttagggagggagtgagggaattttatagggagtttattttggggagggatgttttttattatttgtagtaaatgatattagagaagtatgtgtgagatttttggtgtttagaggaggggtatgtagtatagtatgggggtttatggggttgtagtgattttttagagatggtgttatgtttgggatgattattaagttaggatgttgtaaagagtaattaaataagttttaatagggttttggtatgaggtgagtagttaatttaaatgatatttgaaatgttttttaatgttgtaagtgtatttttttgtaaaataattaattatttaaaagatatttttatttgtattatgttatttaatttttatagtgtttttatgggataatagatgttatttttatttgtatagagtagtaagtgaggtttatattggttatagttagaggagtagggaatttaaatttaagttttttttattttaaattttaagttttattagtatgttatattgttattgtgggttgaattttttagtaggggttgttttttttatttgtaatatttttttttttggtttgtttattttttagagagagaagggatatgtatttatggagattttattgttgtaaattttgtattaggagttttatatgaattgttttatttagtttttataatagttttgtgaggtataggaaagttagatttatttgtttaaattaaggaatgtggttaatttaagagtgatgaaggttaggtgtggtggtttatgtttgtaattttagtattttgggaggttgaggtgggaggttgaggattgtttgagtttaggagtttaagattagttagggtaatatagtaagatttaatttttattagaaataaaaaagaaattagttaggtgtttgtagttttagttatttgggaggttgaagtgggatgattgtttgagtttgggaggtagaggttgtagtgagttatgattttattattttattttagttagggtgatagagtgagatttagttttaaaataaaataaaataaaaaagagtgatggagtaggaattttatttgttattagagattatatatgtttttttttatggtttaggttatttattatgtttttgttaaatttttttttttgagttttgttaaagtttttaaggttagaagagtggtttataattataaaaaattttattgtatgattttagttatttgtaaaattgattgagattaatgtattttttgtttgtttttatttttttattttttgtttagtgtttattttatagaaaggtgtttggtagatttaggatatgattgtttataggttttaaatgtggttaaattaggaaagttttttggtttttggttttaagaggttaattgttgagtattagtttggattgtttaatggattttatgtttaattgttgtgtttatttgtttgtttgtttttgttttgtgagatatatttttttttgttatttgggttggaggttagtggtgtgaatatggtttattgaagtttttattttttgggtttaagtgatttttttgttttagtttttttagtagttgggattataggtatatagtattatgattggttaagttttggattttttggtagaaatggggttttattttttgtgtaggttagttgtgaatttttggtattaagggatttttttaatgtgttgggattttggttttttaaagtgttgggattgtaggtatgagttattatgtttagtttttgtttaattgttaatattatgaggtttttttttaatgaggaagggaggtttggggaggtgtgatggggaagatggagaagggtaggagatattataaaattgatagaagtgtggtatgattaagattttggttttttagattatataagtaagtgttattatttttttgattaatatttgattttttattttttttttagtatatagatagttgttttaggttgtgaaaaaatatatttagtgaaatgaaatatagtagatatgtttattaagaaattaaaaagaaaagttagttataaattattttattttattgaaatgtttggttgaatttataagaatgttgatgaggttatttttggatgtttgtattgaaatgaattatgagaggaatatttaggatatgttgaagaggttgtttggtttaatgaataaaggagtttttgtaggtttagggagtggaatgaaaattggtatgattattttggagaatatatggagttaaatagagaatttgaatggagtttttaaagaggatatgttaggggaataaaggttgataaataatatttgtatttgtaggaaaatagggagagtaaattaaggaatttaaagagaaagagaaatttattttaagtaggggagaaaaaatttttataatttttatttttttttgtaaataaaaaggaaataaatgaaaataagatattagaagttagtaagaatttatgggagtataaagttggttttatggatgtaaagttttttttattgttgtatgaaatttttggttgtatgttaataatggataattgatttttttgtagttgtattttgttgttttttgtttttggtttggatttagtattttgggtttgtgggaaattagaattgttttagagttttggagggtaggttaaggttagatgttggagtgggttttttaatttattgtattgattttttttgggaagaaagaagattgtttgttagaattttagttatgagagatgattatgaaatagtaaattaattttaatgatttgagttattttgaaaatttttagttttaggataaaaaatataattttatttagaaatttttggtgtgattatagatgtagtattggttttttttatgaaatttgtaaattaaaaagtatataatttaaagttaattaaatagtaagttattataataaatttttttattttattagttttttaaaatgtggataattatatatttaatttaaggaatttatatttttttattgattgttaaagattaatggaaataattttagtttttgtagtattttattgtggggtgatttatttttgaaataatgtattggttttagttgatttttatattgttagttattaagttaggtttgatgagaaatagatataatttgatttggggatttaagtattatattgtatttttttttataattagagataaatttgttatggtttttttttttataggtttatgttaaagtttggtatttttataatatttttttttgttttatttagggaggttaggtgtttattgttttaagtttttattggattaatttttgaagaatgattgattatagtattaaagaatgttaaaaatttttggattttgtattaggttggtttgttaaatttgtatttattgatggtgattattttgagagtatgaagaataattttttatttattttgtttgattttattgaatttgagaaaaagtttattaaaggaattgttgatttttttgttttttgttttggatttattttgagtttttaatttttggatttttatatgaagttttgttaattggaattttttaatttgaggtaattgtttttttggattgattttgaatttaattatttttaaatatttattgtggaaaatggttggtttgttttagggattattaagagagatgatgttaaatatatgtattattttaaaaagtttattatggaaattttaaaaggtatgattgtgggtaaagtttttattttttgttaaaattttttggaaaaaaatttttaagattatttaatataaatgatgtgaatttatatttttaaattttaatggagatatttattttggtaatagtagaatgtatttatttaatattttttttatttggagttttgaggaatttgaattaatttttaaaaatttatttgtaaatgagaaattgggttataatatttgtaattatttaatttttagttattaatttagatttttagattaaattgaatataaaataaattttaggatatttagttttttgtatatgttttttagtttttgttattttggttgaataaaatattttaaagaaaaaggaatgtttatgttttttagagaaaatagtataaatagattatgtttttaaagtttttatttatttatttattgtattagatataaagttgggtgtttaggatggaaagtggtataagatatttttttagttttgtagaatatttattataaataaggaattatttttttaaggtgtttagaaatttaaaaaatatattagataggttaattttgagggtatttatttgtagagttatataggtttgattagagttttttgttaagaagaaaaattattggtttattaaatgagaagtattatattttatttatttaagtaggaaatgtttagttgtttttgaattatgatgtaagtgtttagtgaagggttatgttgtttttgtttttttttttttttgtagttattaagttggatggggtggatgttattgggtatattgtatggttttttatggatggttttgagtggtatagaggttatagtattaggtgtggatttttttatgttgattttttaagttaggataagatgttgttgttaaagtttttagttttgttttattaaaagttgatagagaaaaatggttttttttttttatttgaaaattagtttttagaagggatatttttttgtgattttgtttggggagttgttgataattatatttaagtaagttagttgataaaattaattagtagttttattaagttttattattagtaagtagtgttttttttttaggttgattgttatggtatattgtttgttttttgagttaaaaataattttttatgagtatattaagggtataatttggaatgttgtatttttttttttaaaatttttttaatttttattttgtttaagttagatttaaagataaataaatttaaagtatattaatatttaagatttgattaagatagtaaaaagataaaatattttttttttatattgtggtttttgattttttttaaggtagttgagtttttttatgaataggatttaatatagaattttaaagtttttgagttttagtggtgttgttgagattgaggtaggaatattaggtagagttttttagaggtataattgtgggttttataaatgtgtagaaatattttaagaaagtaaattttagatttaatgatttattggttagaatgttttttttagtaatagttattgaaatgatatgaaatttttttagaatgattaattaatatttattgagtatttttttagtagtaagtttttaatatttttttagattttttaaattttgaaggggtttgttttttagtatttgattggatattttagtaagtatttattggatgtttagtgtgtttgaagttttgtgttagttgtttgggttgtttggttaaggggagtgtaggtagagggtatattgagatgagtaagggtaatttttgtttttaaaggagtaaaggagtttattgagtgaaaataatgtatgtataaatgatgtaatggagtgaagtgggtatggtggtaagtaataagggtggggttgggggattgttgttgatagagttttaagtgtgaaaatagtttttaagatagagatagagtttagtgtttatagataagtagttggttttgatatgttgggttatggtagttaattaattggttttgtaaattatagtttgaaaggaaatatttggaagaatgtgaaatgggttgttgtttttttgtaaatatttaattgaaattttttatttataaggaaataaattaatattatttttagtatattttttgttggttgggattattttttttttttagattatttagtttattttataggtagttttagatttaaatttttgttttttatttaaaagatgattggtttatgtttgtaattttagtattttgggaggttgaggtgggtggattatgaggttaggagattaagattattttgaataatatggtgaaattttgtttttattaaaaatataaaaaaaaaaaaaaaaattatttgggtgtggtggtgggtatttgtagttttagttattttggaggttggggtaggagaatggtatgaatttaggaggtggagtttgtagtgagttgagattgtgttattgtattttagtttgggtgatagagtaagagtttgttttttaaaaaaaaaaatgattggatgtgttattttttatgttaggatatgtgagtttaggagaaaggtttttgagtttttttttgtttggtgtgtaattttttgttttgttttgatttttttttttttttttagttttttgttatttgaaatttttttattttaatttttttttttagagtggattttattgtggggtttagagaggatttgaggtgggagaagtgaggttggtgaggaagaaggggaggagaaagggaagaagatttttgtagtttttttttttttttttttttattggggttggggatagattggatggtttttggtttttgttttattttttgattttttgtttgttttttgttgagtatggatttttgatagtagtttgagtttggtaggtttagttttttgtatgtggtataattttttagttagtattgttgtgtagattatgggaatgaatgtagaataagagtgggggtgttggagggagttttattttttttgttttattttttattagggggttgtgtgttggttttgggaattggtaaatagtgagaaagttttaagggtatattttatttttttgagggagaagagaaaatgttggttagaagtaataagtatagtagtgaatagtaagggagatgggagataatttttttttttattatattttagaagttattgttttagaatttgatttaaggttagttattaattggttttagaggttttttttttagattatatggtttttttttttttattagtttggggattttatttttttttttggtagtttttttttgtgtagaatttaataaatataaaattaagttatttttaaatttatagtagatgagagtttttttggaagttttttggtggggaaaggttgtaattgttattttttttttttggtttttattttaggttttgtgttatattgatagtattttttttaagttaattttttaattgatttgatgtagttaaaataagttttttgtatgttagttttgaggtgtgtgtgtttttatttataaatagtattttatagttttaagatattatattaaagttttgagaagtgatttttaaattattgaattttatttttttttttttggttagtattttagatttttagtgtttgaggtatgtattttatttgaataatttgaaaaataatattttaagaagtatataatttgattttaggtttatttatatggattgttattttatttggatttatttttttggttgagaggtttgtttttttataattatggatgtttatagttaatataaatattgaatttattatgtagtgaggatatagagtttttttaatattggtttttgttaggagaaagttttttttataatatattaaatatatgttttaatagttgttttttttgaaaggtttaattttattattttatttttttagtaaaattttagttaataaattaatggaggttaggtggaattttgttttaaaagttttgtattttttttttttttttttttttttttttgatagagttttgttttgttgtttaggttggagtgtagtggtgtgattttggtttattgtaagttttgttttttaaggttatgttatttttttgttttagttttttgagtagttggggttataggtgtttgttattgtatttggttaattttttgtatttttagtagagattgggttttattgtgttagttaggatggttttaattttttgattttgggatttatttattttggttttttaaagtgttgggattataggtgtgagttattatgtttggtttgttttgtatttttaagaaatttttttttttttttagaaatgatattttagttttttatatttgtttttagatggattgaataaaagttgttgttttggaataattatggttaaaaaaaaaagttatgaatttagttaatttagagttttataaaaataatttaaaaaatttttttaaattttgaatgttttaaaagagtgtgtaaatattttgttttttaaagttaaggaaatatgatttgtggggtgtattatagtggaaaaatattttgatagtatttttatagtattaggggaagtgtatgtgtgggtgttttgtaagggataattttttagaaaaggtaatttttttttgatatgttgtttttaatgatttttttttataaatatatttatttttttagagaaatagtagtgtatttgtaataggtttgtaaaatgtaataaaatttttgttatggtttttgatttttgtttttatatagagtattagattaaggaatttgttttaataggattattttagaggggaatataggtttagggtgtagattttttagttggattttttattttgtattttttttatagtagatatatgaaggaatgattttgtgattttgattttataatttgtatattttttttaaatattttttttaaatttttatttgggaggattttatagtatatgattgagaattataattattattattgttatagaagaataatttagaaaaattttttaattatgttaaaaattttattatgggtggatgataatattgttttttttttttatattttttttttttagatttttttttttttttttttattttttttttgagatgaagttttgttttgttatttaggttggagtgtagtgttatgattttggtttattgtaatttttgttttttgggtttaagtgatttttttgttttagttttttgagtagttgggattataggtgtgtattattatatttggttattttttgtatttttagtagagatggggttttattatgttggttaggttggttttaaatttttgattttatgatttgtttgttttggttttgtaaagtgttgggattataggtgtgagttattgtgtttggttttttttttggattttttattattagttagattgaatttgttaaattttgttattgattttaaatttaataaaaggtaagagttatgtttatttagtattttttttatttatagtaaattttaatttagagtgtaattttaagtataatttaattataaatatttttttatttttttatttaatttatttagttttttaaatttttttttttgagataagattttgttttgttattgaggttgatgtatagtgatgtgattatgatttattgtagttttgattttttaggtttaggtgatttttatattttagttttttgagtaattaggattataggtttgtgttattatgttgggttaagatggggtttggatgtgttgttttagttggtttttaatttttggttttaagtgatttttttgttttggttttttaaagtgttgggattataggtatgagttattgtatttggttaatttatttatattttaagtttttttttttttttatttagttttttttttttttaaatttgaaagttttatgatattaatgattttttatattaaaagaaaaatatttaaaaatattttgtttatataatattgataagtagtgtgtaagatttattagtatttgttatttgaagtgattaaatttagatttttgggggttatattaaagaaatagttgaagagttagaattatgggtaaagtgagtgtgtatattagaaagtggaatattgttttttttaggagttgataatttatgaaaaatagtttatatttttagttagaaaggtttttatttttgtttatatttttggttagttttgttgaaataattgttttgaattatttttttaggattgtttaggtgatgttaatgtttattttgttttttataggtagatattattttgttttagtttattgatttgaatgtttatttgtgggatgtttattatagtaaaaggtttattaaagtggatggggttgtgattaagaagaggaaattttattgtgttgattttgttgttatttagttttagattgttttattttaggaaatgtatgttatatatttttgtttttttttggattgggttttgattttttttttgggtaattagttttaggtgaattatattattttgtagtattattgttgtatggttagtgagtttgtttgtgttaatattattttagtggtggttttgtggtagtttatggttttgaattaaggattgttgtgttttttggttaggtagggtgtttgggagaatttttatattgttttggtttttgtagagtatgtttgattgtgtttttaagagtttggttattatgttaagttttggataatgatgaatgagttgtatataaggaatatgatatatagtgttggttataattttttgaaggtttatgttttggtttggtatgtgtataatgaaaagtttaggtatgtttagaatgggaaaatatttatagttttgtaggttgattggatagaatttgtttgtttttttttttaaaaggataaagaggtggttgagagagttttggaatttgatattggttggttggttgagtttatttttggttttggagattatttatgggtgatgagggattggttgaattaaagaaataattttttttttttttattttattgaagatgaaaaaaagttaatttagggtatttttgattttttggttttaagttattatattattatttttgtagatttagaaaaagaagatttaataaaatataatgattatttagaagtgtaagaaatgattgatattatgtggtttaatttttttagttaggtggtggtagtgttttgggggttgtgtaaagtgttgaattggttgaagtttaagtatggagatttttttatgtatataatatttaatggaattgatgatgggttgtatgttgaggatgattagttgagggtgtattatatgtagaattatataaatgaagtttttaaaggtaaggagttttagttgtggttattttttgaaggttatgttattagagggtatgatatttgattaaatttttaatattaatatatattgttatttttggaatggagggttatttattttgtgttttattgaaatagtttaagagatatttagtatttttttaaggataaaggagtgtagttaaaagtagaagattagaaatttttagtttttattttggatttatgtaagtttagatttttgttttttattttggatggttttatagtagttttaattgttttatgtatataaagtagtatataaagatttaattttgttgggtatggtggtttatatttgtaattttagtattttggaaggttaaggtaggaggattgtttgagtttagaagtttgagattagtttgggtaatatagtgagattttgtttttattaaaaattataaaaattagttgggtatggtggtatatatgtttgtagatttagttatttgggaggagaggtgggaggattgtttgagtttgggaggtttagttgtagtgaattatgattatagtattgtaatttggtttgggtgatagagtaagatattattttaaaaaaaaaaagattaagtatggtggtttatgtttgtaattttagtattttgggaggttgaggtaggtggattatttgaggttagaagtttaagattagtttgattaatatggtgaaattttgtttttattgaaaatatgaaaattatttaggtgtagtgatgtatatttgtaattttagttatttgggaggttgaggtagaagaattatttgaattggggatgtggaggttgtagtgagttaagattgtattattgtattttagtttgggtgatagagtaagattttattttaaaaaaaaaaaaaaaaaaaaaaggatttaatttaagtatattatagtagattgaattatgtaaaatatttatttaataattaggtttaggtttgttttttttgtgtagtaaattaattattgtgatataggttttgtaaaagagaaaagatttatttgtaaggggattaagtgagggggtgggagaataatttttaattttgtttttttgaagataaggtttaggaatatgtatgggttagggaatgggtggtttaaggtatggtgaagagtgattggtagggggggaaaatgaagtaataggttagatatatgtatagaaaatggtggtgttagtatgatttgagggtagagttttgggttttttgatgttaaaagattattttttaggtatttgtgtaggtttagtggaagggttagtggttttaattagtttgaattggataggagttgttttaagtttttggaaaaataattgaagtgattattgttatggtaatttatgaatgttattagtaaagtagttagtgaaggttaagttttagtatataatgggataatttttagttttatggaaaaaggaaaaaaaaaaaatatatatatatatgaaaagtaagtgattaaaagtaagtaggataggtagatttgatttaattaatttttgggttttaattttgttaaatgtagtttaatatttgttttgataatttgtttatttggttttatataaaataaagttttttttgatgaaatttaattgagtttgaagttgtattaaatggtattggaaattttttagtaggaaggttatgtaaaagtggttgggtgtggtgatttatgtttgtaattttagtattttgggaggttgaggtaggtagattataaggttaagaaattgagattattttggttaatatggtgaaattttatttttattaaaaaaaaaaatataaaaatttgttaggtgtggtggtgtttatttgtagttttagttatttaggaggttgaggtaggagaatttgttgaatttgggaggtggaggttgtagtgagttaagatggtgttattgtattttagtttgtgtgatagagtaagattttgttttaaaaaaaaaaaaaagtgatgtgttgtgtgtaaaatatgtaataattatttttttatttttttgtttttttagtttatatattggatggtattaatttttgtggatattttgtttatttgtttaatgattgtatagttttgaggtttggtttttattgttatgttgtagattagtttgagtttaaggtatttatgaaatattataggaaaattattgatagtaatggttttttgggtttagaaattttggaaagattttgtttagaagaatttattgtgtgtattgagtgtagttttttttatatttgaaagtttttattggtttttatagtttttttattttttgtttttattattttttttttttttatattttattatttgaagaaaggtagaagaagttataaatagttttgaatatttttttatttatttattttgaaataattatgtagatatattagttgttaattatttgtatttttaagtgttgtgaaattgtaaattttatatatttgatttttagaaaatatttttgtggtttatgatagaggttttgaaatgggtataggtgattgtaaaatattgaataatgtgaatagtgtttgaatttgttttttttttgggtgattaaaaaattgataggtattataatttttgtaatatattaataaaagtatgaaaaataggaattatattaatgtaatatttgtgtagaaatttgaatgataagattaggaatatttttttttgtatttatttttaaatttaatgtttttttggaagtagtaattgtaagagtttgaatagaaagttatgtattaagtaattattttttagttgttataataatgtttagtggttttttttttgttaaatttagttttttatggaaaagaagatggtagatataggagagatgatagagggttttaggttggaatgttttttttgaaagtaatgtttttattaaatattagtattaatttatgtatttggttaatgatatatttggagagtaaattatggaaatgtgtattttatatgatttttgaggttttgtttaaattttgtgtttttgagggatttgttttattggtattttgttgagggttttgtatataggaaatttttgataagtatttgtggaaaaataaatatgaattttgtgatattgggttttttaggaagtataaagtaattgtgaaatatagtatattgtagtggttttaggtggaggaaaggaggaaaaagtgtttattatgtgtaatattatgattaatttgattatatattatttttgagtagattttggaatgaatgatatgatttttttttagagaataaggatgaaataattatttattttatgaatagtgatattattttttattttttagttgtattgtaatttttttgagttgatagttttataaatttttaataggtttaaaagtaatttggtttgaataatattggatttgtttttgtgatttttgaggtttattttatgtttttgttgttatttttgtggaagtagttttgaattagttttattttgaatttttatgttgaaatatgttagtgatatttagaaagggttaattaggttttattttttaatgttttttaaataagttttgttgatttttagatagggaagtttttttattatattggagttgttttatagataagttaatattgtattaggtaagataaattaatgttataataggtattgttaattttattgatatagggttatagtgtataataatatattgtattatataatatattatttttagaggtatgatttttttatgaaagataagtttttggtaatatttattttaaagtggatttattaaaattggatgttagagaattaagtttattttatgtatatatttttttgattataagagtaatatatgtttattgtaaaaatttttaaaatatagaaattatatgtaaagaaaaaataaaaattatttataattttagaatttagaaatagttattattaatattttttatgtattttattttatatagattatattgtatatagttagtatttttattaatttttattatgaaatttttttttgttattattagtttttaaaagtatgatttttaatagttgttgagtattttattataggaatgtattataatttaattgtttttgtttgttagattagttttttattaatgttgatgaatgttgtttaaaaataattttgttgttatatttattttaatttttttgattgtaaagagaagtaattttgttttttgataaagtattatattaataataaatttgtttgtaattttttgtttttttttataattatatgagtggttgttagttaatttttttgtaattaaaaaaatttgagttgattaagttatttaagatgtgatgggagtagtggagaaatgggtgtgattgtaagaggtttgatttatgtggttggaagatggtaggggtgggagggtgatttaggttaggttatgtgtggagtagagagaattttagagatgagatagtgaaa

SEQ ID NO: 245 - DNA, 51912 bp, Artificial Sequence
  Chemically-Treated DNA
ttttgttgttttatttttgaaattttttttgttttatatatggtttagtttgggttgtttttttatttttattattttttagttgtgtgggttaggttttttgtagttatatttatttttttattgtttttattatattttaggtggtttagttaatttaagtttttttaattataaaaaaattagttagtaattatttatatgattatgaaagaaggtaaaaagttgtaggtagatttattattaatataatattttattaaggagtaaaattatttttttttatagttaaggaaattaaagtaaatgtagtaataaaattatttttaaataatatttattaatattaataagaaattagtttaataaatgggaatggttaagttgtgatatatttttgtggtggaatatttaataattattaaaaattatgtttttgaagattaataatgataaaggaaagttttataataaaaattaataaagatattaattatatataatatgatttatgtaaaataaaatatgtaggaaatgttaatagtggttatttttgggttttgagattatagataatttttattttttttttgtatatagtttttgtgttttaaaaatttttataatgaatatatattatttttataattagaaaaatatatatataaaataaatttgattttttagtatttaattttaataagtttattttaaaatgaatattattaaaagtttattttttatgaaaaaattatatttttaaagatgatatattatatagtatagtatattattatatattatgattttgtgttagtgaggttggtaatgtttgttatgatattggtttattttgtttgatataatattgatttatttataaaatagttttagtgtaatagagagatttttttgtttgaaaattagtaagatttatttaaggggtattaaaggatgagatttaattagttttttttagatattattagtatgttttagtgtgaaagtttaaagtaaaattagtttaaagttatttttatagaagtagtagtaaaaatataaaatagattttagagattatagaaataaatttagtgttatttagattagattgtttttgaatttattaagaatttgtaaaattattaatttaaagaaattatagtatagttaaagaatagaaagtagtgttattgtttatagaatgagtgattattttatttttattttttagggaaaggttatgttatttattttaagatttgtttaaaaatggtgtataattagattaattataatgttgtatataataagtatttttttttttttttttttatttagagttattgtggtatattgtattttataattgttttatgttttttgaagagtttaatattataggatttatgtttgtttttttgtagatatttattaaaagttttttatgtgtaaggtttttaataagatgttagtgagatagattttttagggatatagggtttagataggattttaaaaattatataaaatatatatttttataatttgttttttaagtatgttattaattagatatataaattaatattagtatttgatagaagtattgtttttgaaaggaatattttagtttaggattttttgttgttttttttgtatttgttatttttttttttataggaaattagatttgatagaggggaagttattaggtattattatggtagttgagaaatggttatttggtatataattttttatttgaatttttgtaattattatttttagaaaaatattaaatttagaagtgggtgtagaagaaaatatttttaattttgttatttaaatttttgtataaatgttgtattggtgtggtttttattttttatgtttttgttagtgtgttatagaaattatagtgtttgttagttttttaattatttaaaaagagaataaatttaggtattatttgtattatttaatattttatgattatttatgtttattttaaaatttttgttataagttataaaaatgttttttagaagttaaatgtatgaaatttatagttttataatatttagaggtgtaaatggttaatagttgatgtgtttgtataattattttaaaatgaatgaatagaaaaatgtttagaattatttgtaattttttttgtttttttttgagtagtaaaatataagggagagagaaataatagaagtaaaaaatagaaaagttatgaaagttagtaaagatttttgggtgtgaaaaaaattgtatttagtatatatggtgaatttttttggataaaatttttttagagtttttgggtttgggaaattattgttgttaataatttttttgtaatgttttatggatgttttgggtttaaattgatttgtagtataatgatagaggttaaattttggagttgtgtggttgttaaatgaataagtaaagtatttgtaaagattgatattatttagtatgtgggttggaaaaataaaaggataggagagtagttattatgtattttgtatataatatattatttttttttttttttgagatggagttttgttttgttatataggttggagtgtaatggtattattttgatttattgtaatttttgttttttaggtttaatagatttttttgttttagttttttgagtagttgggattataggtgagtattattatatttggtaaatttttgtatttttttttttagtagagatgggattttgttatgttggttaggatggttttgattttttgattttgtgatttgtttgttttagttttttaaagtgttgggattataggtgtgagttattatgtttggttatttttatgtagtttttttgttgggaagtttttgatattatttaatataattttagatttaattagattttattagaaaaggttttattttatgtaaagttaaataggtaaattattaagataaatattgagttgtatttagtagggttgaaatttaggggttaattggattaggtttgtttgttttgtttgtttttggttatttgttttttgtgtgtgtatgtgtttttttttttttttttttttatgaagttgaaggttgttttattgtatgttgaaatttaatttttattggttattttattgatgatatttataggttattatggtaatggttattttagttgtttttttaagaatttggggtagtttttgtttagtttaaattagttaagattattgatttttttattgggtttgtataagtgtttgagaggtggttttttgatgttagagggtttaaaattttgtttttagattatgttaatattattattttttgtgtatgtgtttaatttgttattttattttttttttttgttaattattttttattatgttttagattatttattttttaatttatatatatttttaagttttgtttttagagaggtaggattggaagttatttttttatttttttgtttggtttttttataaataaatttttttttttttgtaaaatttgtgttatagtgattgatttattatatagagagaataaatttggatttggttgttaaatgggtgttttatataatttaatttattatgatatatttgggttaaatttttttttttttttttttttttttgagatggagttttgttttgttatttaggttggagtgtaatggtgtaattttggtttattgtagtttttatgtttttagtttaagtgatttttttgttttagttttttgagtagttgagattataggtgtgtattattatatttggataatttttgtatttttagtagagatggggttttattatgttggttaggttggttttgaatttttgattttagatgatttatttgttttagttttttaaagtgttgggattataggtatgagttattatgtttggtttttttttttttgaaatagtgttttgttttgttatttaggttagattgtagtgttgtgattatgatttattgtagttggattttttaagtttaagtaatttttttgtttttttttttaagtaattgaatttgtaggtgtatatgttattgtgtttagttaatttttgtgatttttagtagagataaggttttattatgttgtttaggttggttttaaatttttaggtttaagtaatttttttgttttggttttttaaaatgttgggattataggtgtgagttattatgtttagtaaggttaaatttttatgtattgttttatgtatatgaaatagttaagattgttgtggagttatttaagatggaagataagaatttaggtttgtatagatttagagtaggggttagggatttttggttttttatttttagttatatttttttatttttggggaaatgttagatattttttggattgttttagtgaggtataaaatggatagttttttattttaagggtggtagtgtgtgttgatgttggagatttaattaagtgttatgttttttggtgatataatttttaggagatagttgtagttagggttttttatttttgagagttttgtttatgtaattttgtatataatatatttttagttggttgtttttagtatgtagtttgttattgattttattggatattatgtatatggggaggtttttgtatttgaattttagttagtttagtattttgtgtaatttttagggtattattgttatttgattgggggagttgagttatgtgatgttggttattttttgtatttttaggtaattattgtattttattggattttttttttttgagtttataaggatggtggtataatggtttaaagttaaaaagttaaaggtattttggattagtttttttttatttttagtgaaataaggaagaagaaaattgtttttttggtttagttagttttttattatttatggataatttttagagttgaaaatgggtttagttagttagttaatgttaaattttaaaatttttttagttatttttttgtttttttgggagaaagggtaggtaggttttatttaattagtttgtaaggttatggatatttttttattttgagtatgtttaaattttttattgtatatatgttaagttagggtatgggtttttagaaggttgtggttagtattgtatgttatattttttgtatatggtttatttattgttatttaaagtttgatgtgatggttgagtttttgaaagtatagttgggtatattttgtaaaggttagggtagtgtaggggtttttttaggtgttttgtttggttaggaggtgtggtagtttttggtttggggttataggttgttatagggttattattggggtgatgttgatatggataagtttgttggttatgtagtgatagtattgtaggatggtgtggtttatttgggattggttatttagagggagaattagggtttagtttagggagaagtgaaaatgtgtaatgtgtattttttggagtaaagtgatttggggttggatggtagtaaagttaatatagtaggattttttttttttggttataattttatttattttaataagttttttattgtggtggatattttataggtaaatatttaggttggtaaattgagatagagtggtatttatttgtgaagggtagagtaaatattagtgttatttgggtagttttgaggaagtaatttaaagtaattattttagtaaaattagttaggaatatgagtaaaaatagaagtttttttagttgagaatgtgaattattttttataaattgttagtttttgaggaagataatattttattttttgatatgtatatttgttttatttatagttttaattttttaattgtttttttaatgtgatttttaaaagtttggatttggttattttagatgataaatgttaatgagttttgtatattatttgttggtgttatgtaagtagagtatttttgggtgttttttttttaatgtaagaaattattaatgttatgaggtttttaaatttaaaaagaaaaaaaattagatgaaaaaaagaaaaaatttaaaatgtgagtgagttggttaggtgtggtggtttatgtttataattttagtattttgagaggttgaggtgggagggttatttgaggttaggagttggagattagttggggtaatatgtttaaattttgttttggtttggtatggtggtatgggtttgtagttttagttgtttgggaggttgaggtatgaggattatttaagtttgggaggttaaggttgtagtaagttatgattatattattgtatattggttttagtgatagagtaagattttgttttaaaaaagaagatttaaaaaattgagtgagttaagtaagaaaatgaaaagatatttataattaaattgtgtttaaaattatgttttaaattgaggtttgttataggtagaggaagtgttaaataaatataatttttgttttttgttgggtttagggttagtgatagaatttaataaatttaatttgattgatggtagaaagtttgagagagaggttaggtgtagtggtttatgtttgtaattttggtattttgtggggttaaggtgggtagattatgagattaggagtttgagattagtttgattaatatggtgaaattttatttttattaaaaatataaaaagtagttaggtgtggtggtgtatatttgtaattttagttatttaggaagttgaggtgggagaattatttgaatttgggaggtagaggttgtagtgagttaggattatggtattgtattttagtttgagtgatagagtgagattttattttaaaaaaaaaatagaaaaaaagaaaagaaagtttaaggagggagaatgtggaaggaaagaataatattgttatttatttatagtggaatttttaatgtagttaaaaaatttttttaaattatttttttgtaataatgatgatgattatagtttttaattatatgttataaaatttttttaaataaaaatttaaaaaaagtatttaggaaaagtgtgtaaattataaaattaaaattataaaattatttttttatgtgtttgttgtggagggaatgtaaagtgaaaaatttagttggaagatttgtattttaagtttgtgtttttttttgaaataattttgttagaataggttttttggtttgatgttttgtataaaagtaggggttagaaattatagtagaggttttgttgtattttatgggtttgttgtaaatgtattgttatttttttggagagataagtgtgtttataaagaaaagttattaaaaatagtatgttaaagggaaattgttttttttggagaattgttttttgtagaatatttatatatgtattttttttaatgttgtgggaatgttgttagagtatttttttattgtgatgtattttataaattatgtttttttagttttgaaggatagaatatttgtatgtttttttgaagtgtttagagtttgaaggaattttttggattatttttatagagttttgagttgattaaatttataatttttttttttaattgtgattgttttaaaataatagtttttatttagtttatttgaaaataaatatgaaagattagggtattatttttggaggaaaaaaaaagttttttgaaaatataggataggttgggtatggtggtttatgtttgtaattttagtattttgggaggttgaggtgggtggattttgaggttaggagattgagattattttggttaatatagtgaaatttggtttttattaaaaatataaaaaattagttgggtgtggtggtgggtatttgtagttttagttatttaggaggttgaggtaggagaatggtgtgattttaggaggtggagtttgtagtgagttgagattatgttattgtattttagtttgggtgatagagtaagattttgttaaaaaaaaagaaaaaaaaaaaaagaaaatataggatttttggggtaaaattttatttaatttttattaatttgttaattaagattttattaaaaaaataaaatagtgaagttggattttttagaaggaatggttattaaaatatgtatttagtatgttatgggagaaatttttttttaatagggattaatgttaaagaggttttatgtttttattatatagtgagtttaatatttatattaattatgagtatttgtggttatgggaaaataaattttttagttgagaaagtgggtttaagtaaagtgataatttatgtgaatgagtttaaagttaggttgtgtgttttttaggatattattttttaagttgtttaggtgaaatgtatgttttaaatattgaaagtttgaaatattagttaggagggaaaagatgaagtttagtggtttaaaaattattttttaggattttaatataatgttttaaagttgtagagtattgtttgtaagtgaaaatatatatattttagaattgatatataaagaatttattttgattatgttaggttagttagggagttagtttgagaagggtattgttaatataatataaagtttgaggtgaaaattagaagaagaaaatagtaattgtagtttttttttattagggagtttttagagaagtttttatttgttgtgggtttgagagtgatttaattttgtgtttgttgggttttgtataggaggagattgttaggaggaggggtggggtttttaagttgatgaggaaaaaaggattgtgtgatttgagagagagatttttggggttaattagtggttgattttaggttagattttaaaataatagtttttagagtgtagtaggaaaaggaattattttttattttttttgttatttattgttatatttattgtttttgattagtgttttttttttttttttaaggaaataggatgtatttttaagatttttttattatttattaatttttaaagttagtgtatagttttttgatgaggaatagaataggagaagtagggttttttttgatatttttatttttgttttgtatttgtttttatgatttgtatagtaatgttggttgggagattgtgttgtatataaaggattgaatttgttagatttaggttgttattagagatttgtgtttagtagggagtaggtagaaggttaagagatagaataaggattagggattatttgatttatttttaattttagtaaagaggaggaggaaggaaggttatggaggtttttttttttttttttttttttttttttttattagttttattttttttattttagattttttttgaattttatagtggaatttattttgaggagggaaattaggataaggagattttaaatagtaggaggttgggagagaaggagagagttggggtagggtagaaaattgtatattgagtaggagggagtttagaagttttttttttgggtttatatattttggtataaaagatgatatatttagttatttttttttttaagagatggatttttgttttgttatttaggttggagtgtagtggtgtaattttggtttattgtaagttttgttttttgggtttatgttatttttttgttttagtttttagagtagttgggattataggtgtttgttattatatttggataatttttttttttttttttgtatttttagtagagatggggttttattgtgttatttaggatggttttgattttttgattttatgatttgtttgttttggttttttaaagtgttgggattataggtgtgagttagttattttttaaatggaaggtgagggtttaagtttgagattgtttgtaaaatgaattgggtggtttgaaaaagaagaataattttaattagtaaaaaatgtattaaggatggtgttaatttatttttttataaataaaagattttaattggatatttataagaaaatagtaatttattttatatttttttaagtgtttttttttaagttgtgatttgtagaattaattaattggttattataatttaatatgttaaagttaattgtttgtttatggatattgaattttgtttttgttttgagggttatttttatatttgggattttattagtagtaattttttagttttgtttttgttatttattattatgtttgttttattttattgtattatttgtgtatatattgtttttgtttagtagatttttttgtttttttgaaagtaaaggttatttttatttattttagtatattttttatttgtattttttttaattaagtgatttgagtaattaatataaggttttggatatattagatatttaataagtgtttattagagtatttagttaaatgttggaaaataagtttttttaaaatttaggaagtttgaaagaatgttaagggtttattattgagaagatgtttaataaatattggttgattattttgaagaaattttgtattattttaatgattattgttaaaaaagatattttgattagtgaattattggatttagggtttatttttttagggtatttttgtatatttgtggagtttatagttgtgtttttggaggattttgtttaatgtttttgttttagttttagtagtattattgaaatttagaggttttggagttttgtgttagattttgtttatgaaaaaatttaattgttttaaaaaggattaaaaattatagtatgaaaagagagtgttttatttttttattgttttaattggattttaaatattgatatgttttaaatttatttatttttggatttaatttaaataagatgaagattggaagagttttggagagaagggtgtagtattttaaattgtgtttttagtgtatttataaggaattgtttttggtttaaagaatggataatgtgttatgataattagtttaggaaggaagtattatttattagtgatagggtttggtgagattgttgattggttttgttagttgatttatttgaatgtagttgttaataattttttaagtaaagttatagggaaatgttttttttaggggttgatttttaggtaaaggagggaagttatttttttttattagtttttggtagaataaggttgaagattttggtaataatattttgttttggtttagaaagttaatatagaagagtttatgtttgatgttgtaatttttgtgttatttgaaattatttatgagggattatgtggtatatttgatgatatttattttatttagtttgatggttgtaaagggaagaggggataagagtaatatgattttttgttgggtatttgtattatggtttaagagtagttgagtgttttttatttaaataaataaagtgtaatgttttttgtttggtaagttaatgatttttttttttgatgaaagattttaattaaatttatataattttataaataaatgtttttaaaattggtttatttaatatgttttttggatttttgagtattttgaaaaaatagttttttatttataatagatattttatagggttggaaagatgttttgtattattttttattttagatatttagttttgtgtttgatgtaataaataaataaatgaaggttttaaaagtatgatttatttatattattttttttagaaaatatggatatttttttttttttaaagtgttttatttaattaaaataataagaattgaaaaatatgtgtagagagttagatattttgggatttgttttatgtttaatttaatttaaaaatttagattaataattgaaagttaagtaattataaatattataatttagttttttatttataaatgggtttttaaaaattaatttaagttttttaagattttaaatgagaaaggtgttaaatgaatgtattttattattgttaaaatgaatgtttttattaggatttaaaaatataaatttatattatttatgttagataattttagagatttttttttagaagattttggtaggaaatgagaattttatttataattatattttttaaggtttttatgatgaattttttgaggtaatatatatatttggtattattttttttggtggtttttgagataaattagttattttttataataaatatttgaggatggttaaatttaaggttaatttaggaaagtagttgttttaggttgggagattttaattggtggaattttatgtgagggtttaaaagttgaaaatttaaggtgggtttaaagtaaagagtaaaaaagttagtagtttttttgatgaatttttttttagatttagtaaaattaggtagaatagatgaaaggttattttttatgtttttgggatagttattattaataaatatgggtttggtaaattaatttagtataaagtttagagatttttgatattttttgatgttgtggttggttattttttgaggattgatttagtgagagtttagggtaatggatatttgatttttttgagtgggatggaaagaagtattgtagagatgttagattttggtatgagtttatgaagagaaaaattatggtaaatttatttttagttgtgaggagaaatgtaatataatatttgaatttttaaattagattatatttgttttttattaagtttaatttaatgattaataatataaaaattagttagaattaatatattattttaaaggtaggttattttatagtgaggtgttatggggattagagttatttttattggtttttagtagttagtggaaaaatgtagattttttgggttgagtgtgtagttatttatattttgaaaagttaatgaaataaaagaatttgttataatagtttattatttaattgattttggattatgtattttttaatttatgggttttatgaaaagaattaatgttatatttgtgattatattaggaatttttaaataggattatattttttattttgagattgggagtttttaaaatgatttaggttgttggagttaatttattgttttatagttattttttgtagttaaaattttaataagtaattttttttttttttaagaagaattagtataataaattaaagaatttattttagtatttaattttggtttattttttagaattttgggatagttttggttttttatagatttagggtgttaggtttaagttaagagtaaaaaatagtaaaatatagttgtaaggaaattagttgtttattgttagtatgtagttaggagttttgtatagtagtgaaaagggttttgtatttataaaattaattttatatttttataaatttttattgatttttaatattttatttttatttgttttttttttatttataaggaagagtgaaaattataggggtttttttttttttatttgaagtgagtttttttttttttttgaattttttgatttattttttttatttttttataaatataagtgttgtttattagtttttatttttttaatatattttttttgaaaattttatttaaattttttgtttgattttatatattttttaaaatgattatgttaatttttattttattttttgggtttgtagaaatttttttgtttattaagttaaatagtttttttaatatattttaaatattttttttgtggtttattttagtataggtatttaagaatggttttattaatatttttatgggtttagttaaatattttaatgaaataagatagtttgtggttaatttttttttttagttttttggtgaatatatttattatgttttattttattaaatgtatttttttatgatttgaagtagttatttatatgttaagaaggaaatagagaattaaatgttgattaaaagaatagtggtatttgtttatgtggtttaagaaattagggttttaattgtgttatatttttgttagttttatgatgttttttatttttttttattttttttattatatttttttaggttttttttttttattgaaaggaaattttatgatgttaatagttaaatagaggttgggtatgatggtttatgtttgtagttttagtattttgggaggttgaaattttagtatattgggagaattttttgatattaggagtttataattagtttgtgtaaagagtgagattttatttttattaaaaaatttaaaatttaattagttatggtgttgtgtgtttgtagttttagttattaggaaggttgaggtaggaggattatttgagtttaggagatggaggttttggtgagttatgtttatattattgatttttagtttaggtgatagagaaagatatgttttataaaataaaaataaataaataaataaatataatagttaaatataaaatttattgagtagtttaggttagtatttagtaattaattttttgagattaaaaattaggggatttttttaatttgattgtatttgaggtttatgaatagttatgttttaaatttattaggtatttttttgtagaataagtgttgaatagggaatgaaagagtgaaagtaaataaagaatgtattaattttggttagttttgtaggtagttgaagttatataatggaattttttataattatagattatttttttaattttgaggattttaataaggtttagaggaggaggtttagtaaggatatgataaatgatttgggttataaggaaagatatatatggtttttgatggtagataaagtttttgttttattatttttttttgttttgttttgttttaagattgggttttattttgttattttgattggagtgaagtgatgggattatggtttattgtagtttttattttttaggtttaagtaattgttttattttaattttttaagtaattgggattataggtatttggttaattttttttttatttttagtagagattaaattttgttgtgttgttttggttggttttaaatttttgggtttaagtgatttttagttttttattttagttttttaaagtgttgagattataggtatgagttattgtatttggtttttgttatttttgagttggttatattttttaatttgggtaggtaaatttaatttttttgtgttttataggattgttgtgaggattaaatgagataatttatgtaaaatttttaatgtagagtttgtaatagtaggatttttatgaatgtgtattttttttttttttagaggatgaataaattaaaaggaagaatattgtaggtggaggaaataatttttgttaaggaatttagtttatagtagtgatgtgatatattgataaaatttggggtttggagtagaagagatttaggtttagattttttatttttttaattatgattggtgtgagttttatttattgttttgtataagtgggaatgatatttattgttttgtagggatattgtgaggattaaatgatataatgtaagtgagagtgttttttaagtagttgattattttatagaggaatatatttgtagtattagaaagtattttagatattatttggattaattgtttattttatgttaaaattttgttgaaatttatttgattattttttatagtattttaatttggtggttattttaggtatggtattgtttttaagaaattgttgtaattttatggatttttatattgtgttgtatgttttttttttggatattaagagttttatatatatttttttaatattatttattgtagataatgaggggtatttttttttagaatgagttttttgtggagtttttttattttttttttggtatatggaggtttttattgtttgttaaattgagttgaattagttttattatttttttatgagttagtttattttttttgtggatggtatatttgatagattaaatattatgaggtagagtgtgggaaggttgttatttaggatgttgtaataaataaggatgattaatagggagatggttatatatagttttgtaatgttttttaattatttttggtatgttaattttataggtttgttgttttaagattgggatttaataaagttattgataaggatttagtgaagttattaattgtatggttaagaatatttatttaaatattatttttaatagttaaatattgaaaataattgaaatgtttaatatttaaatatgtttattatgtatgaatgttttaatatatgatagtataattaaagaaatattattatttaggataatgtaaaagaatattaattaatatgtaaaaatgtttttaaaatattttgaatagaaaaaggttataaaatagtaagtagagtttagtagtattttgatttggagggatttataatttgttaaaatttgttttatagtaggattgtgggtggtataatttattttattttatttatttatatattttttttattttttattataaatatgtattgttttagagattaaaaaaataaaatttaaaaagggaaaatggttgatagtagttggatggtaggtttgtttgatggttattaaaagtttttgttttattttattttgtttatttgttttttaatttgttttatggtttttgtttgaaatttaagttttaggtatattgaattttatttgaagttttaagattatttagttttttatgttttggaggtgtagttttttaaggtatgttttgtttatttttagtttttttatttttatatttattttaaaatttagtttagatgttgttatttttaggaagtattttttgatattttttttttttttagtatggattaaatgtttgttttatgtgtttttatgatggttttttatttaagattttaattatatattattgtatttatttaagtgtttggattgtaggtgttttgaaggtattgagttttttattttttagattttagtaaagtttttgtaatagagttagtatttaataaatagatttagaggaatgaaggttggtattaagaattagattaaagggtttaggatagaagtaatatttttttgggttgaagtaggaaaatttttttataagttattttggtttttattttgtttttaagattatgaaagatagaaaatttttaggtatatattattaaaaaataaattagaaggaattttatatggtaggtttttgagaataatattatattattttataatgtgttaatgatttattttggggtataagttttttttgtatgtgatgttttttttgttttttttttattttttatttagattttgaaatatggagtttgaaaaaaatttagaagaaaaatggatttggaatttttttttattaattagttagtagttttaaattttggaagttgaggaaaataattttggaagttgaggaaaatattttgaattttatagaatatatagatattttttttttggttaaattataagttttttgttatttgtttatatgtattttttatagaatttaataaaaagttttatataaataagttgtttttaaatggtgggtggaaggaaataggtgatgagttttaggtttattttagttttttgttttgggttgtgttttaggtatggttgaggtaaatgaagtttatataatatatagtagtattgttgagttgaaaaggaagaaagtaatgatgaggattttgaagtaggttaatgtattggagagaagaaatttatataaaggaaggatttagaagtttgtatgagattttttaaggatttttggttgtttatgtataggataagattttgtgaggtttagtaaagagaagtagttataggtttgggagatgaatattaaaggttgggtaggtttggaaaatattgtattttagaatagttagagtagaaaaatgtagttgagtattttaggtatttagttgaaatttaggaaggttattatttgagaagtaagaataaagtaggaatagattagttttaataaagattaaagttatattaagtaaatttggtaatttaattttttggtagaattaaatataatattttttaaaaagagataatattgattaggttttttataatattttatttatagtatatagagtataataaaaatttattagatatgtgaaaaagtaggaaaatgaaatttttaattaaggggaaaaaaagaagtatttaatattaatagaagttaagatgttttagatattgggattagtagaggattttaaaatagttattataaatatttttaaggattttaaagaaaagatagatataatgaataaatggagaataataatagagaaataataattgaagaaaatatgaaaattttagaattgaaaagtgaaataaataaatttttgaatgggattaataatattaattttaaatggaataataataagaataaataatgtaatttttaaaatttataaagatattaaaaggtttttttaaaaagttaataaaataagaaaaatgaattattaaaaaatttgatttttttaaaagatgtagaaataaaaaataaaaaatatatggaataaaaagaaaataaatagtaggattgtaaatataaatttaaatatattaataaatatttaaatatatatggattaaatgttttaagtataagatagatgttatgaaagtagattttaggggttgggtgtagtggtttatgtttgtaattttagtattttgggaggttaaggtaggtggattatgaggttaggagtttaagattagtttgattaatatggtgaaattttgtttttattaaaaatataggtgtttgtaattttagttatttgggaggttgagataggagaattgtttgaatttgggaagtagagattgtagtgagttaagattgtgttattgtattttagtttgggtaatagagtaagattttattttaaaaaaaaaaaaaagaaagtagattttagaaaagtaagttttaattatattttgtgtgtaagaaatatattataaatataaagtgattatgtaaaagaaaaagaatggaaagagatatattatgtaaatggatagtattaaaaatttggtatggttatattaataataaaatggaggttttgaatattattataatttatttagagttaatagatatatatattaatagaatatgttatttatttaaaaaaattagaatatatattttttttaagtgtatatgatatattttttaggatagattatatgttagattagaaaataagttttaataaattttaaattgttgagattataaaaagtattgttttttattataatgaaatgaaattagaaattaataataaaaggaaaattagaatatttataaatatgtggaaattgttgatatatttaaataagtaataagttaatgaagaaattataaggtagattagtaaaagtttaaatgtgtatataaaaaattaattgaatatgtaatatattaatatttataaattgtagtaaaagtaatgtttagaggaaattttatagttttaaatatttatattaaaaaaaaaaataagatatattttaataatttagttttttattttaagaaaataaaaaagaagagttaattaaatttatagttaatagaataaaggaattaataaaaattagaatggatatatataaaatatagagtagaaaaattatagaattaataaaattaaaagttggttttttgaaaaaaattaataaaatagattaatttttagtaagattgattagagaaaaaaagagaaaagaagtaaattaatgtaattataaaagaaagtggtaattgattttttttgtatattatttttataataaaaaggattataagagaatattatgaatatttggatgttagtaaattagataatagagatgatttggttaaatttttggaagtatatatattattaaaagtggttaaggaaaaaatataaaatttaatttaggtgtaaaagagattgaattagtaattaaaaatttttaaattaagaaaagtttaggattagtggttttaatagtgaattgtattaaatatttaaagaagaattaatatgattttttttaagttttttaaaaaatagaagaaagaatattttttaatttagttaatgtggttagtattattttgatattaaagttagataaagttattataagaaaataatagttatagattaatattttttatgaatatagatgtaaaagaatgtaattaaatattaataaaataaatttagtagtatattttaagaattatatagtataattaattagtatttattttaggaatgtaaagatgggtaaatattaaaaaaaattgttgtaatgtattatattaatagagtaaagggggagaaaatttatatgattattttaattaatgtaggaaaagtattttataaaaatttgaaagttttttataataaaaatatttagaaaattatgattagaaaggaatttttttaatatgattaagaaaagtatttatgggttgggtgtggtggtttatgtttgtaattttagtattttgggaggttgaggtgggtggattatttgaggttaggagtttgagagtagtttgattaatattgagaaattttgtttttattaaaaatataaaattagttggtgtggtggtaggtatttgtaattttagttattttggaggttgaggtaggagaattgtttgaatttaggaggtagaggttgtgatgagttgagattatgttattgtattttagtttaggtaataagagaaattttgttttaaataaaaaaataaataaataaaaaattatgaaaatttatagttaatattatagtgaaaggttgagagttttatttttaatattaggattgaaaggaagatgtttgtttttattattgttttttaatattgtattagaagtttttgttagagtaattaggaaggaaaaaattatttaagttagaaaagaagtaaaattatttttatttatagataatatgattttatatatggaaaattttaaagaatttataaaaatttattgtaaaaaataaatgattttagtaaaattgtaaggtataagattaatatataatagttagttgtatttttgtataatagtaatgaatagtttaaaaagaaaattaagaaaataattttatttataataagttttaaaagaataaaatatatataggagtatatttaaatatttttattattgttattaaaattgtattggaggttttagttagtgtagtaaggtaaataaaaatataaaaggtatgttgattgaaaagggaaaaataaataaataaaaaaataaattttgttgtttattaaaaatatgattgtttgtgtagaaattttaagatttttaaaaaaatagaaaaattattaaaatgaataagttaatttagtaagttggtagaatataatgttaatataaaaattagttgtatttggttaggaatattggtttatatttatagttttagttatttgggaggttgaggtgagaggttttttttagtttaggagtttaagtttgtagtgagtgttgattatgttattgtattttagtttgggtgataaagtaagtttttgttttaaaaaaaaaaaaaaaaaaaaaaaaaaaagaaaattaattgtatttatatatgaatagaaaataaatagaaaataaattttaaatataatgttatttatagtggtattaaaattgtaaaatatttagaaaataatttaataaaagatgtgtaagtttgttataattataatatattgttaatagaaattaaagaatatgtaaataaagaatgagatattatttttatggattggaagagttaatattgttattagatttttttagattgatttattgaattaatattattttatttagaattttaataaattttttgtagaaatgaataagttgattttaaaatatatataataagaatataaaatagttaaaataattagaaaaaggaaaaatatagttgaaatatttatattatttgattttaagatttattataaagttataattatttaatatagggtgatattggtataaggatagataaatatattaaaggagtagaatagaaaattttaaaataaatttatagttaattgatttttaatgaatgtattaaagtaattatgtggtaataggaaagatgttttaataaatgatttttgataattggaaaagtgtatgaaaaaattaaattttaattttgtataaaaatttgagatagattatagatttaaagttaaaagttaaaattataaaatttatagaataaaatgtaagagaatagtttttttattttggagtaggaaaatattttttagaatatagaaagtattatataaatatatatatattaaaatatttttttttagtatgtgatttgtttttatattttgttaatatttgatgagtaggttttaattttgatgttgtttaatttattagtttttgtttatgattagtatataattgataaaataattatatttgaaataaatatgtaagtttatttattagtagtaaaagaaaaataatttttttttttattatgagtaaaatatttgaatagatattttataagagaatttttattaatgtttagtaaatatatagaaatgtttttaatattaatattattaggaaaatgtaaattaaaattttaatgagtatttatatttattaagatgtttataattaaaaatattggtaataggttgggtatagtgatttatgtttataattttagtaatttgggaggttgaggtgggtgaattatttgaagttaggagtttgagattaatttgggtaatatggtgaaattttatttttattaaaaatataaaaattagttgggtgtggtggtatgtttttgtagttttagttgtttgggatgttgaggtatgaaaattttttgaatttgggaggtagaggttgtagtgagttgagattatattattgtatgtttgggtaatatagtgagatgttgttttaaaaaaaaaaaaagattattaataaattttggtaaggatgtaaaataatggaaattttatatattgatggtgggagtataaatagtattattattttggaaaattatttgatagttttttataaaattaaagatagattttttttataatttagtaagtttatatttaggtatttattaagagaaatgataatataagttttttaaaagatttgtataatattaagataaaatttataaattgatatgtttaaagatgttggttgggtatagtggtttaagattgtaattttagtattttgggaggttgaggtgggtggattatttgaggttaggattttgagattagtttgattaatatggtgaaattttgtttttattgaaaatatgaaatttagttaggtgtggtggtatatgtttgtaattttaggtatttgggaggttgaggtaggagaattgtttggatttatgtggtagaagttgtagtgagttgagattgttgttattgtattttagtttggggaataagagtgaaattttattataattaaaaaaaaatgtttatagtagtttaaattgtaatagtagaaaattgaaaataatataaatgtttatttataggagaatgtataaatagtgtggtttgtttatataatggaatattatttattaatgtaaagagtgaattatttttttaggtagtaatatggattaatgttaaaaagattgtgtagattgaaagaatttagatatagagtatatttatagagttgtttgattttatttatataaagttttaaaattagtttgtggtgatgggaattataatagtggttttttatggaggtgagaattgattagaagttataaagaaattttttggggtaatgagaatattttatatttttatttggatatttgttatagatatttatatatatataggtgtatgtagttattaaaatttattaaattgtttataaaatatgtgtattaattttaaagatttatagattaataaatatataatagattaatattttagttattggtaaagttatttaggtatagaaatataattatttataatttatgtggtaagagaatattgattttttttgaaatataaatttatttttgaaattattatagtaatttgttagttaaaaaaatatatatatttagtttttaattgtagggattatatttatttaataaatattatattaggtatttttttaggggatttaaaatatgattttgtttttatggagtttatatttttgggaagaagagagataataaatgaaaataaagtagagaaaggatagaaggtaatagggattgggatgggaaggtagtttagataggtaagttttttttaaggaagtattgtttgaggatttgtaatagaaaaagtgaagaatgttaaaaaagattgggatttgagatgggggtgtgtggaaggagtagagaatttggaggattgggtagaggtggtagagggtatgggaagggtattttaggtagagttgagtaagtgatgagagtatagatttagttaggtttttttaattttgtttttttattagttgtgggattttgggtaaattatttgaagtttgtgtttttatttttttatttgtaaagtagggatagtaatagtattttatggttatatttttgtgaggattaattaagttaatatatggaaagtatttagaattgtaaatgttatggaagtgttttttatttaagtgttgtagtaatgtttgattggtaagtttaaagatatttatagtattaggttggtgttaaagtaattgtagtttttgttatttaaaaagtaatggtaaaaattgtaattattttggtattaatttaatagttttaattataatagtaaaaaaattgaaaataatataaatgtttatttataggagaatgtatgaatagtgtggtttgttaatataatggaatattattttttgtttttttgtgatttttaattaatttttaatataggagattattgttgtgatttttagtatatagagtgattgtgggattttatgtaaatggaattaaataattatgtaaatgtatttattgtgtttgggtaatgattgataagtttttaaaaattagtggttattatgtggaaaataggatttaggaggataaaatgggagtaaggatattagttagataattattgtaatggtttaggtaaaagattatgatggtttggattaaaaaagatagtaataagtggttagatttaggttattattgaaggtagaatttgtagaatttgttgatgaattggatgttatatgttgtatgtgaggaggggaagaggaattaaggaatttaaagaaaataaaaaataaggagttggggaagggaagggattaagttttatttaggttataagtttagtttttaatgaagatgtttggtatttagttgagtatatgaagttgaagttggagagatatggatggtattattaattatttaaatatgttttaggggtaatattgaatggattgttttttgttatttattatttattagattttttaaaaattgaaatggaataatttttaaaggattaatttaattttataaataattttaattaaatggattgagattaatggtggaagaaatgaaatgtagtttataagtagaaaataatttaaatagtttatttatgttttttttttatttaagaaaagggttttttagatgttattttagttttgaattaaaggtgattgtttttaaaaaggttaaaggattgaaaaaattttagaaggtattagagatttattttttttttttttttggtattttattattttaattttaagaagagtattgggattatattgtttgaggatttttttaaaagttattgttattgtgtggtgtttatataagtatgttaattagtttgatgtttgtgtttgtagattaaattattttttttatttttattagtattatggtttataagttgtagttttttaagatagaattttaaatagttttttataaaataattatttaatagaatatataaataattttttaaaaataattatttataattttatttataaaaaatagttagtagtttttgtgtgtagttttttaaaagttgtttaggatttaattaatgtaagggggtttatatttgttttttttgatatttagttagatgaatatgtgtgaataggtagtagtttggtatttttatttgttttggattttttagtaaattaaataagttgtatttttagttttgagtattaagttttatagttttttataaagtaataggaagattagtagaattgtatataaatgtaaatagtattattttttagtttagttgttttgttatagttaggttagttttttattattttttatttagggttgtatttatgttggatgttaatttattagttttgaagttgtattttattttttttttatatttatatttttttttgttttttgttttggatttgttttttttaagaagtagtttttaatgaattttatttatttttagtattattttttttaattattaattgaaaatttttattttttttaaatttggtttaatttttattttttttgtgaagttttgtttggttttttatgtgtatttaggtattttttttttaatgtattttatttataagtaggagtaaataatatgtttttttatagttttttttaagttggtggttttttattaagattgtattatatttttttataataataaagttgaatggaaataatttgaatatttaataatgtggaattatttatttatttatttttttatttaaatatttattaagtaattattatgggttatttataatttttaaattagttgaaataatttaaagggttaataatagggattagttaaaataatttaggaataagatattaaatgaaataaattattagtaataaatgattagtgttgataaataaattataatttattaattttatgagtaataaatgattattatggataaatatagtttattaaattataaattatagttagttatagatagattatgtatagtattatttaattttggaattatatgtatagatgtaaaataaatatatataagataggattttaaaggatttgtatagagatagtagttatagtttttattgagtaggatagtgggtatttattatgtttttttgtttttttgattttttgatttttatgtaatgaaatatgtattgttttttgaataagaaaatataaattttttaaaattggaatttttaattttggaaaattttttagtttaaattatttattatattgtttttttaagttgatgatgtttgttttgtttgtttagttgtttttatttttttttttataggatggatggtatagattgttttaattaatttaattatttattttttaatgattatttattgattttttaattttttattgttatattttttagttattttgatttttgaaaaaatttgttagaaatgttttaaaaatttttggtatattaaaattattaatattgggaagtttagtaattgggatttattttttattaaatggtttagttgattaaattattttttattaaaatgtttttgattatgttgtattttattaaattatttggaatttttttaaaaaaattgtaagatttaaataattaagttaaataattggattattttttttagtttgtgttatttttggggtagatgggttaggggaaaagagtttttaaaatatttttttatagtggattttggttggtgtttagggagggtaatggagtgtttaagtatggaaattatgattaaaggaatagatataagaatttatttaatgtgttgtgaaaatgatgatattaatttaattaggttataggattaatagtttgtggtttttagaaaataagattataatagatagtatggggttagaatatgaaaagttttgaatgtaaagttatttggatttgatagaataggttataatagattagtataaatttttgagatagtgatgattagttatatgtttaaaattatttattgtagaatgtattagaatgtgaatagttggatgtggaaaattggtaggatattgttaaaatgtagatataattaaggttttggataaaggtgatgattattgaaaagtaaaataatagggtaatttgagagatgtttggaagtgtagaataaaaagagtatggtgtattagttatatattgtttatatgtttatgaagaaatattatttgtgagttgggttgggttttattgaatatgttttttgttttggttttatttggttaatttaggatggtgttggttgggataaatgggataggttgtttttgttttatatgttttattttttagtgtattagtttgggtatttttttatggtaattgtagagaagtaagagattaagtagatattaataagtatttttttagtgtttgttagtattatgattgttggttaaagtaagttatatggataaagttagagttaaaggagaagaaggttagagttaaaggataagttgaatggatatttagagtagaggatattgtaaagttatatgataaaaggtatggatataatgaagagaggataatattggggtttttaatttaattagtttatattatattgtaatttattagatttaggtattaaaaaataaagtattaaagttgatagtttatgtatagtatatagttagattaaaaaataagttagtttggaaaggtgaagatattttttgttttttggttggatttataggtttaaaaatttttgttgttttttttaaaagtgatggttttgtagatggtataatttttatgttaagatatttatttagttatttatttaataaatattatttaatatttattatatgttggatatataagtgttaagaatatagaaatgagtaaaattttaagtttagatgtatgttattatttattatatattaatattgatagaaaaattgatttttaatgttttttaagatataatttaaaagaagatatatgatttttatattaagatttttttataagtttttaaatattagtatatttagtattatagtattttgtttttaaatttttgttaaatttttaaggtaaagtttattgttgtatatgattgttaaaattttttattttattttaagaattaagtttgagattagattttttttagaaattatatgaaattatgatgtatgttatttttgagaaatagataataagattaataataggtttattttattttgttttattgtggtaaaatatatataatttaaaatttatttttttaatttttaagtgtatagtttgataattgttttagtaagtatttattatgaattattatattgggttttagagatagtaaatataaataaggtaaaatatttgttgttatgaaatttttattattatttattgattttataggaaatttataaaaataaaagaatattgttttttttttttgtattttaagttgaatgatttaagttaggttaatgagatattttttttgagattgttttgttggaatagagatatgtgattgttttatattaggagaggaagtgaatttggagttgttgatatgggaagagattttttgggatgataaaagttaaattgatttaagtataagtgtatgtgtgtatgtttgtgtgtatttttgtgtgtgtggtgtggtgtgtgtgtggtgtgtgtgtatgtgtgtggtatgtatgtggtatgtgtatgtgtgtgtggtgtgtgtgtatgtgtttagtgagggagaaggagaatttattttgatagtaatggttattttagtgataaatatagttgttaatatttaaagtttttggagtttttttttaattttttgtttttgttgtaaagtttttttttttttttaagtttgttttagttagggttggttaaatgtaaatatagagttttttaatataaatataattaaatttgagattttataagaatttgtttagttaaaagtatattgtaataattaggtaagataaaggttagggtagtttttgaaaattatgttgtaattttggagttttgttatttaagattgttttatttggatttttttaaagtaggtgataataaagggtttatttatttgtatttaaataaaaattttttttaaatgaaataaaaaagattttataatttatattgggtaaatatattaataaattagagattgagttttttgttttattaatttatttgtatagaattaattaatattagttaaattattttatttaatattaaattatgttgtggtgaaaattattttaagttattgatgttaggttgttaataaaatatttagtttgtgattagaatttatttaatttattaattatagaattattattggagatatagaggggttttaatttttggtttttgtatttttgtttttttaatagtaataaaatgagaattatgagggaataggtagggaggtataggttagatgagaaaaaagagataagaagataaggaatttagataagtgatgttttttataaggttagtaaaagtattttatggtttattagttaaataggatttttttagtaaatatttattagtataattgttaataattttataatatttttatgaaagagttattttttaatattaataaaattgagataagtagttttttttttataatggttatttttattttttaaatattttatttttgtttttttatttaatttttttgttttaagttattaatagtagatgttaatagattttttttgagattttttttaataggtttatttatagttttttgtttttgaaataatttaatttattttgtagtagagaatgttttttatttaaagaaaaagtggtatgtgagtgtgtgaggatttttatattattgaataggatataattataggaaaatgaaatatgttttatggagtggtggatagtggaaagttattggtttgttttttttttttttttttgtatttgtttttttgtggtagtagttttgatatggtgttaagttaaagttttttataatataaattttatttgtgaaattaatttatgagtagttttagtaattttgaaaattaaaatagaagagattaggaaatattatagtgtattgtttgtaataatggtaagttttttttgtgaaaattttgttttaatggtgtatatttaatatggaaaatgttttttttattatgggttaagattaaaaaagtttggaatttattggtttaagtggagggggatttttattttagaagtatttattgagtatttattgtgtgtttggtatgattttagtattttggggtataatagggaataaattaaagaaaaatttgtgtttttatggagattttattttagtaggaggagtgataattaataataaatataataaatgtaaattataaagaatgttttaaggtaataagtgttatgaagaaatagagtgaggtaaggaaggtttggggtgttatggagaggagatatattttatttatttttttttttggtggtatttataagagtttttattttttttttattaaatgtgttgtgatttttatttttttatttatatttttatagaataaaatttgtttgtgtttttattaggtaagaattttttttattgttattagttttttataagttaaaaattatttttatagaatttaaaatgttttaatttatggtaagtagtaaattgaataaaggtgtattgttttttttatttttagagaatgaggataggagaatgggattaattaggtaggtttgtttgaggttttagtttagatggatattaataattttgttttatttttaagtttaggaaaattttttgtatagtttttttttgtgattataaataatttttaaagattatattttattatatagaaaaatttggtttttttgagttttagttagatttatttataaatgtttgataaggggtgttaattaatattttataagttttttggttttatagtgtatagtatattaaatttaaagaaatagtttttgtttggggattttataaggaattttagattgtttttttaaaagaaggtaatttgagggtgtgtgtttattttttttaaaaaaaaatgtttttatattagagggtttgtgtttgtttgtttttattttttttaaaaaaatgattttattggtttttttatttagaagttaaaaaaataagtttaataaatttattattatatagttttatttatagtatttgtaaatttggtgattttttgtttttttgaggtttttagaagtagttagttttttttgttgtttgtaaagtgggttgttggaagtagagaagattagttttgggggtttttaggagataggaagttattaaatgggggtggttagaggtgtgttttttttgagaaggagtttgtgattatagatttaaggaaagtgaagggttggttttgtggttatggtggtagggtaggttgggaagaattttttaggtagggagaagagtaaaaaaaaataatgttttaaggtataaatgtaagatttttagtgtggttggatggtgtggggtagtggggtaggagttagagttgagataaaatgtgttgaaatatttttgagagtgtttttagaatagggaattgtagtgttaattgttgtttgattttttgtgatgaaagggaaatttttaaaatggtaaggtttaaatgtgaaaggaaaagataaaaagttttttaattaaattgtaaatgatatggttttttatttttttattttttgtattttttattgagtagtagtaaatataggaaatagttatgtataagttatattgtaattttttataaaggattttttggttttttttattttttggaaatgagaattgtgaaggaagaaaaaagagagatttgaattgaaatgtatttttttaggattgttatttgagttattatgtaatgattattttattaagtaaatatttatttaatagataaattattatgttgggtattgtgaggggttaaatataggtatatagaataattatagtataagtttgaaagtgaaaatgttagaagatggattttttttttaatgtaatggtgatttagaggaaggaaagatttttttttgttgagggaaattaaggaagtttttttgtaggaggtagtttttaaattttatattgaaagatgtagattttggagagatggaaaaaggtattttaggtagattattgtgagttggaaagttagtgatgttgtggtaaaatgtattttttatagaaaatagatgggtattttttatgttttatgattttttatgatataatttggttgttttttttattggtggatttgtggatttttttttttgaatttgtgggtatgtgattgttttgatagaaatgaagttatatgatattaagaataagtgaaaagaagaagaagaagaagaaaagaagtttatattatttttttttagtttttttgggatgtttgttgggagggaagttagtttttatgtatagaggttattaatttgagattatttgtgtaagtgaggttaatagagatgttttggtttatagttaggtttaattgtggattatatgtgtgagttgttttgtatgttttattttgtttaagttttagatgattgtggattagagaaaaattgtgtgggtgagtttttttttaattttgatttataagtttgtaaattaaataaaatggttatttaaagtaattaagtttgggggaattatgtagaaatagtaatgggaatagatgtatttgggttagtgtttttgtaatgatgtaatgatgatatttttagatgttaattaaggttaaagatgttagtggtaagttatgattaatatttttgtttattttagatgttgatgtggatgaggatggtttaggtatttgttagtatatttttagatgtaatttgtgtaatgtgggaggtagtttggagttatggaatgtatattgggaataggggtttagaaaatttgagttttgattttagttttgatttttggtatttataggaaagttagttaaattttttgggttttttaatgaatttatttgttttaaaatataaaaaaaaaggattttagaaattattaagtattatttagtggtatgggttttttaaattattttaaattaataaatgtatttatatagtttaaaattaaatagtattaaaggtttattatgaaaatagtaagtattttttttaattttgtttttaatttttatttttgttttttattggtaattttttagttttttttttttgtaataattattatatttttaaatattatgttattgtgaaatttaataatttattaggataatgaggagttagtttttttatatgttttattttttttttttattttttgaaatgtttgtttttatttaaattattgttagtatttatatgaagatttttatataaatgtttattttagagttaaatagggtattataatattttttttttttaaatagtttttaatttttttttgaataaataatgattttattattaagtgtgtagaatattttatatgtgatttttttaatgtgttagtgattttttattatgttttttatgattgtatttattttgttgagtttatttttttatttagagtttttttttttttgttagaagtttttagtttttaagtttagtttggattagatgttgttaagagttgtttttgttttgggagttttttttattttttatggattgaaattatattttttttatatattatttttttttatgtatttattataattttgttggtgtatattttttattagttttttaggaaatatgatattgaaggtgaatttttaatatttttatatgtttatatatttattgagttaggaatttagttggttttttaaagttaaaagtttatgttttttagttttggggtattttattatattatttttttataaattttttgatttgtatttttttattttttttttttagaatttttattagtttgatgttggatttttatgaatattttttaaattttttttttttttaaaaatgtgttttatttttttattattttgtattatttttatagtattgttttgattttattttttaaatattttattaaatattttgttttaattattgtgttattgatgtttaagaattttttatatgttttgatggtttttgttttagtttgtgtatgtgtttaatttttgtataatttattttttttggtttgtttttttgtttattttattttgttttatgttgatagttttttttaaatgttttttattagtattgttattttttgtttttttgttgtatttgtttttttttaagtttgggtttttgattattgtaggagataagatttttgatgttgggagtttgtatgttattttaaatttattatttttaagtgtggtttagtaaaataatttgtatttatgattatgtaatagttattagttattttgagagattatagaaaataaggtgtttgaagaatgaaaatttttttaattttaaaagggaagataatgtgaattttagaaataatagatttaagtaaaattaggtaatggttaataaaaatgtattagtattatggaagggaagataattaggagataatatggatttttagaataaatttattaaatttagtttagaaaatttttattgtattatatggtgttatgatttgaatgtttgtttttttaaaatttatgttgaaatttaattgttattgtaatagtattaagtgagatttttaagaggttttattttaggttaattaggtaatgaggtttttgtttttattaatgaattaatgttgttattatagaagtgggtttaatattttaggtatgggttttttgtaaaaggatgagtttagtttttttttgttttttttttgtttttttattttttattatgggagaaagtagtaagaagttttttattagatgttagagatttgtttttggattttttagttaatagaattgtgaggaaataaatttttttaaaaaaaaaaaaaatagggttaggtgtggtggtttatgtttgtaattttagtattttgggaggttgaggtgagtggattataaggttaggagattgagattattttgattaatatggtgaaattttgtttttattaaaaatataaaaaattagttaggtatggtggtaggtgtttgtagttttagttatttgggaggttgaggtaggagaatggtgtgaatttgggaggtggagtttggagtgagttgagattgtgttattgtattttagtttgggtaatatagtaagattttgttttaaaaaataaataaataaataaataaataatttagttttagttatttttatagttgtataaaatgaattaagatatatagtatatttgagaatataatagttatttttgtatgtaataattttgatagttgttaaatatttttgtgatatttttagggttaaaaagaaaagtagagtgtaaataagatagtattgttgttatttgaaaaaatatattttaagagtatttattggtttaataaaaatttatttgttgtttattaagtattaaatgttggttaatgtttgaaatattgatttatgggatagattgatttgagagaaggtgattaataatattttataaggtttatttataattttatttttttgtaatttgttattattaaagggatgaaaatttataaaggtattaatttaaaattttgaaaattttttaaaatttgaatttaaaagagttttatagagtgtaatgttataaatatgtgttataattagtaaaattaatatttaaagtgatagaaaaaatatttatgtttttttaaaattaaaaatataagtaatatatgtttatggtttaaaatgttagaataatttataagaaaaattatagttttttgttttatattgttttataatttttttagttttttttagaggtaattatttttgatttttaagatgtttttttttggaatttatatttttatatatttatattttaggaagtatttattgattttttattatgttagataagggtttagtttttttatataggtaatttagttatataatagttttgggtttaattgatatttggtattgatattattttgttaatatgaatattatttatagttggattttgtaatgtagtaagtaagattgtttttttttttatttttgttttttttgaagtttataattgtattgttttttgattggttttgttttttttgggattgtggttaattttttttttaatttttaatagttttttagtagaaatttttttagggaagttatatgagtttttaatattttggggggatatatttttggaattttttttattttgtattggttgattttagtttgttgtatatttgatattatgggtttatagtttattattttttttttgggttagatttgtttttttatagattttatgtttttttttttgttttttttatgttatgtggtggttattttttaataattttttgagaaagggtttatggaagatttattttttgggattttgatttttatgaatgattgatagtttagataagtattaaattttaggttggaaataatttttatttttttttttgaagggtattttttattagtttttgtgatggttaagaaatgtattgtttagtgtttttgttataaggagtatagttgattgaggttattagttgttatttttttgaatttgttattgtagttgattttaagattatgatttttattggttatttttagatgattaaatatggtaggggaattaatgtaggtttattttagtaagatgtggattttgttaatgggtaatattggtttaaggtgtttttattagtttatgtttgggttgttttgagatttatagtgttaattgaaattttttttagtttatttttttttttgtttatttttttttatagttgttggatatatattatgatttaaaggtttaatgttttttttagtttttttttttttattttttataattttttttttaataaattttttgtatatttaattttattttgatatttattttttttaggatttaaattaatataagaggggttggggaattagtttatttattttttggaaagtaaagagaatgttattttgagtgttgtgtaggggtagatagtttttttgtataaatggtgttttaattgttaaatattttaatagtagtaatttgggaaatattttggtggagaatgttattgtaggtgtaatgatttaggtattttttgtttataaggagatggaattgaatgttttttgatatattgtattgagattttatagagagttaatgagaaattgagggttaataataaatagttaaaggtttaatataagagttatagtttttttttttatagtggaagagtagagaaatttagtagtaggtttaggatttgatagatttgtagagatttagggatgtttaaatgtttagttaaggtagattagttatgttaaggttaaggttttggttggggaaatttgggaatatttggagtttatagaggtggtttatttttttttagtaagagatagtatttttttatgttgaagaggttttgtttttaaaaagtaataggtgtattttttaggagttgatttggtattaatgaggattaaattttagtataatttatttggagatagttgggtttgatagagaagaaaagatattatattttaatattgttttaagattgagtatgtattgtaaattttgaggagtagtgttggggtttttgattaaggaattggaatttaatataggataagaaataatttattatttagggaatattttttttggaagtatgtttttatgatttagtaaggattttaggagatgtggtaaagttgttgttagggtggttttgagaagtttgtaaaaagggatgtttaatgttgagtaggtggaaatgtttgatattgttgttttaatagttgataaaagaattaagaagtagagagaagttggtatgtaagaattagtatattatgtgaggttaaataatttattagaggatagtgttttttagaagttttaagtagggagaaagagtatttattgtatttttaggaatatgtttatgggggtgttaattttattgagatatttagtgggggtattgttttttaggttagggttgttggtagtagaggtgttatagagttgggtttgttgttatttatggggatggttagaagttgaaattatagaggttagatagtgagtggtgtttaattgttagaagttagggagttataaagatggtttatagagtatggttatataaaaagtgatgattttttgtatagttttttgatttagttaattttttaagttataatttattgattgaagaggtgtttaggtttttaggagttaggattttgtaataatatagaggtatgatttttttattttattttttttatttaatatgaaaatgtatgttttttagttataggaaattttttggaattattttattgttttttttttttttatgttagttatttattgttgtgaaatagattgtttttaatttggagaattgaattaataagaatttatttttttttttttgtttttgtgagttaatggggtttggttgggtaaatttagttttgagtatgtagttagggaagggatattgtaagggaaaaggtattggtagggagaatgaaggatagaggttagagagagtttagttttatttatgaattatatagtaatttttatatattttttatatatttatttatatagaagagatataatatgggttgttttttaataattatatattaatattttaataattaattagtattttattgtataagtgtattaatatttttttaatggattattttaatatatttagttgatgtttagttttaaagaataaattattattagtggtaaatttttttttatttttgtatattggagatgaaatttaataagattgaaagtttgaaaataaattattaaagagatgatagggatgtttggttttatagtaatttataagttggggggaaaaaatttgagaggttttagttgattgtaaattaatttgagtttgtggtaaggtgatagttaaaattgttaatgtaattttgggtggtatgaataaaatttagtgtttaataagaaatgtaattgttgaagtttattttgaatatttggggtattgtttggttttgtatagtaaatgttaagagaggttttggaaatttttaggtttttttttttagttttttatttttttttatttgatgttttagttatttaaaagattttatgttgtggtgggaatggttatattgttttatttgtattgattttgtaagggatgttttttagaaaggtataatgttttttttattttgtgtgtttagtaagttaagtttagtagtagggtttattatttatttttgtaaataaagttttattgaaatatagttgtgtttatttattaatatattgtttatggttgtatttatgttgtaattatagaattgtgtaatagttgtaatagatattgtaggatttgtaaagtttaaaatttagttttttatagaaaaagattgttagtttttgattttataagtattgttttttttgattgtttttgtattatttttttaaaatgttaatttatttttttttttttgaaataggtttttaagtaagtatttattttttttaaggtatttatatattttattgtaattatttgataattattttttttttattaatttgtgatatgagggtaggaattttattttattttttttttttgatagtgtagaaatttggaaatggtagttttggttaggaaggagtaaaaaggttttttaggttaggagtttttttatagtttatgttagatagataggagaaaattgaattttttgtgtagtttaagtagtatatttttggtgagtaatgtttatgttgagttgtgtttgattgtagataatttttgggagaatgtagttgagttgggagtgagatgtttttattattgtttttgtatttgtgtagggttggtataaaggtttgatgggaataaggggatataggtttttatggaagaatttgggatattgaagagaggaaaaggtagaggaaagaggattatatgatgagaaattaaagagaagagaggataggtggggaagagtagtatttttaagaggttttgatagggtaatgggtttgttttttatgtttttatttttttttgtagttttgtagttgttttttggatttttatgaaaagagttttataaatatgttttttttgggagttagggttttggattttttatagggtttggtatagggagaattttaattatttgtttttagttttttgtatttattagtaggataatggtgatggatgatgagatagaggtaggttttatagataattttaaattttttttgttggggagataggttgatttttttttttttttttttttattttattttgaaatgttagaagatagagttatttgtttaaaggttatatttatatttttagaatttaatattgtatttgtttgttatagggtaagtttttaagaaatgtttttgattaaatgtttagttatttttatgtttttttggagtagatattagtatgaaggagaaaattttaggaagaataaaatgtattggtttttttaaatatgtgaaagatgtttttttaaatatgtgaaagatgttttgttaaaaagtgatttgttttattttttgagatttaggaaggtaaagagatagttatggaggagttttgtgtagtagtaggtttaatatgaaagagaaaattaagggggtaatttgagtggaattgagttttttttgttttaaagggttaagtaaaagttagttgattttaggagagttattgtaaggagtttgttttggagagaagtgtaatttgggattttttaaattttttttgattttaatattttaattattaaataaaatgtatttatagatatggaaataatatttgtttaattattatatttaaaattaatgtatattattgtttttagtttgagtattttattaagttataatgatattggtttatggatgatgtgatatttgtattttaaataaaaaatgttaataaaaaaatttattgaaattggggttataaaagtttaattaatatttatttttggtttagttaatatataaagttatattagttataaattttagtatgtatttttttattattaagttggatttagaaagatatttgataatgtgttttatgtaaaaatatgttattttaaaaatgatttgatagtttttggttaaatgttattgaaataattttaaagaagaggtaaattaagtagttaagtgaggttattatgtttaatgtatttgtatgattttttttaaatagtttaagaggattattttttaagtattttgttattattattattattattaatgataaatttatagtttatttttgtagagttttttgtatttttttaaaatatgttgatatatataaggtgtttttaatttttataatatgtttgggagttaggtaatgtggtagagtttgttggttattttaaatgatttgtttttatttgattttaatttaatagaattatttattgagtatttggttttttaggggataattatttgtagattttttttgattatgtgattgagttttgtttaagggatagtgataggtgtagtttttaggttaggtatttgagaggttattttttttttttttttttttttttttgtttattggatgaaattgggatattatgtgttttggaaattaataaaggttatataatgtatttgtttaggaaaatttttattgtttttttttattttttaaaatttttttttagatattgtgtgagagtagattgtaagtgtaatattttatttataagaaagaatatggatatgttgaaattagaaatatgtattttatttttttatttatgtttttattaaaaattgtattttttttttttgtgttaagtattgagataagtattataaattttgaaataaatatgataggtagtttgtgtttttaagagagttataattgagtaaatgatttattttatttgtggttattgtagaatgaaaatatttgagttaagtttttgaagggtaagtaagagtttattttaagataaagaggggaaaaaggtattttttaggttatttttatatttagaatatattaaaatagagtatataaaagttatattttgtttatttgtttaaatatagattttaagtataattttgtatttttggagaaaatgtggatttgagataatttaataagttgtgtgtttttatttatttattattatttgtttttttagtaagtatgtattttattttttttttttatttaaaattttttttatgttttaaaaagataatatttattgaaagaaagataatttttgtataaattaattataataaaattttagtttagagtaatgatatttttgagaatataagataatttagaaggtttttatgtgtaaaagttgtgattgttatatatttagttggtatagttaattgtttatttattttgtatttgagaaggtgtattgatattatttgaatgtatagtttatatttttttttttttttttaatttaaaataattggtattgttaaaatattgttatgattttgaaatgatttgattaattttttttttattttaaaatttttttttggatttgattgtaatttttaaaaaataatgtgtttaaaaaggagtgatttaagttgtttgggagatattttaattatttttgattaaatgtattattgaatttagtagtattttaaaatttatattaatttttaatttagttgattattttagttatgtataaaatatatttttttgagatggagttttgtttttgttgtttaggatggagtgtaatggtgtgattttagtttattataatttttgttttttatgtttaaatgatttttttgttttagttttttaagtagttgggattataggtatttgttattatgtttggtgaattttttatatttttagtagagatggggttttattatgttggttaggttgtttttaaatttttgattttaggtgatttatttgttttagttttttaaagtgttgggattataggtgtgagttattgtgtttggttttaaatatattttaatgaaagaaaaatttgtaaagtattttttaaaagtgtatagtatatgtaatttgagtatatatatagtagataaattgtttatattaattatttggggaataaaaatttaattagttaataaagttttttttaatatatatttttaaagttggttaggagattttattatttgtttttattttgaaaatttttttataatgttgtatggtgattatagatagtttttaattggatatttttataatggaattatatatttgatgatgaattttaaatttttattgtagatgttagagtttgttatgttatgtttatttatttttttttattagattaggatttggtagtttttgttttattggaaagtggttagaaagattgataaggagagaaaattttagtagtatgagtttataaaggtgaaattaggttatttggtaaattagaagttattttttgagtattaagggagggtaagatgttatttttagagatatagatgaagggaataggattattttagatagtgaaggggtaaaatggagataaatggttaaataaagggaagagtgtgggaggaggtatttgagtaaagtgaagttttgtgtaggatgttatagaaggaagagatggtatttaggtatggggtttaagggagtgtgttagttggttttagaagaataggtgggatttgaaaaagtaaggattttgttttgtttatatataatgttattttgtagagtatttattatggtatattgtagggggtaaggtagaaataagaattttagtagtgaggttgtttttattatttaggtaaggttggatggtgttttgtatttttattgtagttatagataaggggagaagtggtttgattttggatatattttggaggtaggtagagttgtaggatttgttgatggattagaaataagatatgaaaaaggggagtagttaagatttggggtttaataattggaagagtaaaaagttattataatagagaaggggaagtaggggtttggtttgggatgtgtttgatgtgatatgtttattagatatttatgtggagaaggtggttgtttatgttagtttgatgtttggggaaatttgggtggagatttaaaatttttagttattgggatgtagtagtatttaaagtaatggtttggagtgaatttagatagagttttgagttttttattatttataggtaaggtgaggaggaataagtaaaggagattaagagggaattgttagggagttgagaggagaagtaagggagagttagggtttgaaatttaagttgaggaaggatttaagggataagaagtgatggttttaataaatattgtagatagatgggttgagatttgtatattgatgttaatgtttaataatgtttagattaatattttttagttttatttttttatgtgaaagaagttttttttataggttttttgtataaatgtttgtaagaattttaggtggtgaggggagttgaaggtgggaaatgggaatatgtgtatttttaatttgattttaatttttttagaatttatatatagaataaagatttagaggtattgttggggttgaattttttaattatagtttttagtgttgattttaggggatattaagaattttgttttaagagttgtgaaggttgagtagttggtttttaagtttgagagaaaaggtgtatttttttggattatatttaaatgagtaaagtagtttgagttttaagttttttgtaggagatttttttttttttgttttttttttttttttttttttttttttttttttttgtttttttttttttttttttttttttttttatatatatatatatatatatatattatttttgttaaggtttattttagtatgaggaatttataaagaatattaagatttttattttgagtagggtttttattatttgttttgttgtttgtttgttttgttttttgttttttaggttattaatgatttttgattttttaggaggggttaagttttttattattttaggggatttttttagtttatttgtaagttagtggaaatatagagggagtgagggaagggtgttagttagtttttattttttattaatattagattttggaatataattggtttttatatttgtatagtagtaatatttaagttttagttaaaatgtttttttattaaaatttgtagaatgttttattttttttaggtaagtttaaatttttttatttttgttttttttaatttttatatatatattgagaaaggttattgaaaatagaatgaaagtattttatataataaaattaatttaagatattttttttgataatgggaatttgtttttaaataagatataagaatgattaaatattaaattaaaagaaatgtgaaagtaaaattaatattttatattaattaatagtttgtttgtaatattagtaaatggagtatttatttgttattaatttttttaaatataaagtttattgtatttttaggaaggatggttagtgtttggtaaattttttgtgtaagtattgaaaaatataattgagaagttaattagagggttatgagtgggtaaaaagatttaaaatatgttgattatttaaaatattagagtattagagagtatgtaagtttttattttataataaaatgattttataagttattataataataattgattattttgtatatgtaagtttattttagggattttaaaaatagaatttgtaggatttaaatttaaagtaaagattttatgggtatgatttattagattttttagttgatttatttatttgtttttagtatgaattgataatttgtttatgttttttttaaaaagtgagattattttttttatagtttttttattattagttatatattggtggtttttagagttttttagatttataaaaggattgaaaaagtataagaattattgttttaaaatatttttatgaaaagatatatataagtatgaaattataaaaattataatgtgtttttaaataaatttaatatttttttatggttagtagtagtaaataggttttgtggaattgatataaaatttaatttagttattattataatattattagtagtttagagtattaagttattttaataatttagtattgttttgtttatattatttatggttttaattaaaagtgtttagaaatggttttagtattgattttgtttagaatatgtggttgaattttaaatttaaaaataagttttttagtaggtttataagtgattagaattgggtattaaaagttgtatatttaaatatttttattaaaatgtttatatatgtatataaaatattttattgtgatataaaattttgtataaagtgtattaataattgatatgattataaatgaatttttaaaataatggtgtttaaatttgaatattaaggagaaaaaaggaggaagaaatatttgagataattttattatggtatagtaatattttttgttgttaaaattaataaaatattttgtataagggtgttataattaattttattaggttaataatgttataagtgaggaatttttttaattgtagagagtattgtggaaatatagatgtggtagaataatttatattattttgtagttgtttttgtgtttttatgattagttttgtttgagattgtataaagtggtttttatattttggtgaataagattggtggatgtagttttttgttttgttgtagaagggatttttaaatatagtttaaatttgattttttgggagttgtgttttgatatttttataatagtgtgaatttgtgttataagtaagatagattttattggattaatattgaatttgtgatagttttagagagtaatgttatttgtgtggtttaagaataaatgtgttttttttatttattttgtttattttttttttgtagttatttttagtaaattttttttgtttttatttttaggaatttttttatatttagagaaaggagtttttttttttattgtggaaatttattattgttttttttttatagatggattttaaggggtatttatttgtgtgtttattaagggattttttttttaattttatgttttttaagggaagttagaattgtttagttttttttggtgattatatatatgtgtttaagtgaagttttgtttgggggagatttagtttttatatttttttttggtttttgtggaggttttttgttttttttgtgtggttttttgtttggttttttgtatttattaggaggaggttgtgtgttattaggtatttgagttgtgggttgttttggatgttgggggttaggtgtttggtggtgtagttgtgttaggttattatgtaggggttgttgatggtgatttagtatttgatttgattgttgaagtggtggaagtagagttttgtgtaatttttgaagtggttggttagggtgtggttggtttagttgttgtaggtgttttgtaggtgttggggtaggttttagtggtatagggtgattatgggttgtatgtttagtttttgtagttgttttagtaggtgttggtagtagtgtagttttttgtggttggggatgtttgtgttgttattggggagtatttgtgtttatgagatggagaagtggtagtgagtgattttgagtttgtgtagtgtttttgtgttgtggaagatgttgttgtagttgttgttggttatgtttttggtggtgggttgtagtggtgatggggtgtttaatggtagattggtgttttgggagttttttgggggtgttagggggtggtgggtgaatgtattttagatggatgtatttttgttgtgttgttgttagttgtttttggtttggtaggtggtgttgtttatggtttagaggaagttgttggggaaggtgttttggaagaggtttgtggttttgggggtaggaggttgtgagaaatgggtttaggtttgtgtgttgttgtttggttttgtatgtaggtggtggttgtttaggtttagtagtattagtagtagtgatagtgatggtggtggtggttgtgggtggtgtggtggggtgttggtgggtatgttgtgtgggagttaggttttggggttttgtgttgtgtttttttatgtttgtgttttgttgtgtttgtttgtttattgttggtgtgtttatttttgttttttggtgggttttgttggtaataattatttgtgagttgggattgtttttgttttggtattgggggtgggggtaggggtgttgagggtgaggggtgtttgggaggggtgtggtagtgggtaaggtgtggtaggtgttgtttgtggatgttggagaaaggtatttgttttttttagtttttgggagttgtgtaggatgttttgtggatgtttaggtttattttttttgtttgttgtgtgttttttgagagtagttttggagtggttttgttggggagaaaaggtgttgattaattttttttgatttgggggtgggattttgttgggttttagtggagtgtgttgttggggaagtatttgtttttattttttttttatttggaggtttaaagaagttttggttggatattgttggagttaattagggattggttgaaattttagagggattgttaggtgggatagttgagggggaattttgttgtgtgttgaaagggatttttttttaggtgagatgtttgtggggagatgtgtttatttgtgttttttttttgaggaagataaagtagatttatgggttgtgttgggattggggttttgtttttttttttattgttattttttaataattttaaattagtattttatttttgattagattttttagaatattttggtgaattttaaattatagttgttgattgtttttttgaaaaattaaatattaagtttttaattttgagtaaattttatttatttttattattttttggtatttgtgttattttttggttttgatttagtaggtaatttgtgtaaagttgtgtgtataggtttgttggagtgggaggtttttgggttgtatatttgttatttgagttgtggagggaaaggggagggagaatttagttggaatatttatttttattttttataatataatggagttatgatgttttttttgttgttaaagagtttttttgatagaagttgtagagttatagtgtttatttggatgtgggtagataggattgtggttaattgaaatatagttggtggagattgagaaggtttaggttttatttttgtgatttggggtaggaaatttttgtaagtttaagtttttttttttataaaataaggatgttttgtttgttttgttgttttagaggtttgtgaagtttagtgaaaaattgtgtaaaggtgatttaaagatagaaagtttagataagtgaaggattttgttaatatttttatttttttatttagtaagttgtgttttagtttttttatttgtatatgtgtgttgaatgattaagatttttatagaggtgtatttatttttttttagtgatttattttttttgtattatttaatataaatttaaaggtaataatattttaaatgttgtagatgaaggtgtttttattaatttttttgaaatataagtataaatttattttagtattttatgaaatatttttaattttagttagtatatattattatgattagtaagattaagtttttagattgaaatagagttattgttattttgttaaatatagtatttatatttttttaataaatatgaaatagtaaattatgatattttagtaattttaaaaaattatagtatataattttattgttatgttgttttttagttaaatttaaaaagttatgtttatatggagtattatattttttttttagaagtgaagattggagtgtttgttgggttgtagtttgttaagttttaattagaaatgttttatgggttttatggaaaattgtttaagttaagtatttatttattgatgtatggtttgtttgtttagggtagattttatttattgttatttttatttgattagtagtattttttaaattttaaagtagtgattaaaa

SEQ ID NO: 246 - DNA, 2914 bp, Artificial Sequence
  Chemically-Treated DNA
ggttgagggttggagaaatagattaagagatatttgttgtgagggtgtggtgatttaataagtggtttaggtatttttgattgttttaaagtttttgttttttttttttgtttggagagggggttttgaggtggtagttggggttttatttattgtttgttgattaggggagggggaaagtaatagtgtttataaagggtttagtggtaaggaatgaaatagggtgttgtgtggagtaagtttttgggtaggtttgggaaggagaaaatagggttgttggggtggtaggtgaagtttttggaggtggttgggttattggggttagagagtggggaggtggtggtggtatttgagttttaggattttgtgttgttggtggggtttgggggattgggtaggtaggggatgtattgtggtggtaggaggtgtttttgggtattgtttttgggtagtttttgatttgttaggtgtagtgttttggttagagtttagatgtagttgtaggtgaagtgtagtgttttgattttggtgagtttggtgttgttggggaatgagggtagtatgttgtgtagtgtgtttagggttgtgtttaagttgtgtatgtggttgtgtttgtgattgttggttttgatgtgttggtttttgtgtagtgagtgtagtagtgttttggagtggatttgtgtttggttgtggtgttgttgttttttttgtttgttgttttgtgtttttggaattttagatgtttgggagatattgggtgtgtttttgtgggttggtgtgggtggttttgaagtggaggttgtttgttggagtttggtatagttttttttgttggtgaggaagttggataggttattgttgttgttgttggtgtagttgaggttggagatgtaggttttaaggtgggttggtattgttgtgttgtgtaggattgatggatagatagaaaggtgtttagagtgttgtagtttggattgagggtagagttgttagggtgtatttatgtttttaatagtttggggttgttattttgtgttagttgtgggtgtgagagtttggaagggtgtaggggtgtatggagaatttggtttggtttttttgttttgtttgtaggggttatgtgtttggttggttttttgagtgatgttgttggtgattagattagtttgtgtgagtattgagtgtggtatatgattggttttaggattttttaagtatttggtgtaataatgggtgttttttttttttgttatttttgtttttgtggtagtttgggtgaatggagtgaggtggtaggttatttttgtgtagtgtttgggtatttgtataatttatgtttgtgggaggttgttattgttttttttttaatttggagtgtgtttgtaattattgttggttaattggtggtgttgtgtggttttgggagttggtttgggttaagttggttagggtgtttttaggtagtgaaatagaggtggggttggtgggtgattagtggttgaggtatgttttttttggggtgggttgggtgttttttgttggggtgggatggggaggtggggtgtgagtgtgaaagtgtgagttgtttagtgagttgtggaaatttggagggtatttggagtttgggtttgtattttttttttagttgtttagtggttgtgtgattttggatgagtaatttaatttttttgagtattgttttttttatttgtaagatgagataaaagtttattttgtggaggatgattagatataatgtttgtggaatattaaatgtgtagtatttgttgaatagggtgaaaattatttttaaatagattggagagtggttatgttagaggtatagggtgtagggtaaggataagtgttgttgttttgtttaggttgatgaagaaatgggaaagaatttgatttttatttggggagtgtgaagaggagagtggaaaagaggattgggtgattttttaggttgttttgagttttggttttattttttttttttttttttttttttttttatttttttttgtatttttgtttataagttattttaagatttttaataagaattaataatatgagaatttatataaataataatatgagaatataattattaatatgagaatttttttttttttggtgtttttgaaattttgtttgttttatgtttggagaaatttgttgtatattgttttttggagttttgtttgtagtttttgtggttttttttagggtgagttagttaggggatttagtttttttggtttgagagagagttggtttttggagggtagtaggtgatagtggaattttttttttttaaatttttttttgtttttggtgttttaaatttgtttattttagtaggttttttttttgtatgttaggagttattttttttttgttatttatatttatttaggagttataggggtttagatattatttaattttgtatttggaggataaatagtaaggaatagtatttgattataggatgagggtattaaaaataaaatgagtagtttttagtaaagtgtttgttttttatttgatatttaagtggtagttttaggttggatgtttggtttgttgttatgggagtttagttgattttttgggttggggggggattggtttttttgagaaagggggttgtgtagtggtagtttttattttgatttattgattagtgtttgttttttggtttaggggattttgtttagttgtttttttttttgattgtattttgtaggtatttttgattttagtggaaggttaggatatagttatatataagggtttgagatttattagaagttatagaaagtggttttgattagtttatttaggaaagggtagttgttggatggatatgggggttttttaagaatttaagggttttgaggat

SEQ ID NO: 247 - DNA, 2914 bp, Artificial Sequence
  Chemically-Treated DNA
gtttttgaagtttttgagtttttgagaagtttttgtatttatttaataattgtttttttttgagtgagttggttgaagttattttttgtgatttttaataaattttgagtttttatatatgattgtgttttagttttttattgagattaggggtatttgtagggtgtagttggggaaggggatagttgggtagagttttttgagttagaaggtaagtgttggttagtgagttgaggtgggaattgttattatatagtttttttttttaaaggggttaatttttttttaatttaaagagttagttaggtttttatggtagtaggttaggtatttggtttgaggttattatttggatattaggtggggggtaggtattttgttgaaagttgtttattttgtttttaatatttttattttataattgagtgttgttttttattatttattttttaagtataaagttgggtgatgtttgggtttttgtggtttttgggtgagtgtaggtgataagagaaaagtaatttttgatatgtagagggaagatttgttggaataggtgagtttaagatattgaaggtgggagggggtttggaggaaaggggttttattgttatttgttgttttttaggggttagtttttttttgggttaggggagttggattttttggttggtttattttgaagagggttatagaggttgtaagtagggttttaagagatggtgtgtaatggatttttttgggtatggggtaggtaaggttttaggaatgttaaagaaaaggaaatttttatattaataattatatttttatattattatttatataaatttttatattattaatttttattaagaattttgaggtgatttgtgggtagaggtgtggaggagggtggagaagggaagggaaagaagggaagggtgagattaagatttaaggtaatttgggaaattatttgatttttttttttatttttttttttgtattttttagatgaaggttagatttttttttgtttttttattagtttgaatggagtagtgatatttatttttgttttgtgttttgtgtttttggtatggttattttttagtttatttgaaaatgatttttattttgtttagtggatgttgtatatttagtgttttataaatattatatttgattattttttatagggtaaatttttgttttattttataggtggggaaagtaatgtttagggaagttaaattatttgtttaaagttatgtgattattaagtagttggagaggggatgtgaatttaaattttaagtattttttaggtttttgtaatttattgggtggtttatatttttgtgtttgtgttttgtttttttgttttattttagtgaggggtgtttagtttgttttaagaggagtgtgttttggttgttaattgtttgttgattttgtttttgttttattgtttggagatgttttggttagtttagtttgagttgatttttggggttgtgtgatgttgttgattggttggtggtaattatgggtatattttgggttgggggaggggtgatggtggttttttgtgagtataaattatgtaaatatttgggtgttgtatggggatgatttgttgttttgttttatttatttgggttgttgtgggggtggaggtggtaagggaggggggtgtttattgttgtgttgggtatttaaggggttttgaggttagttgtgtgttatatttggtgtttatatgagttgatttgattgttggtgatattatttaggagattggttgggtgtgtggtttttgtaggtgaggtgaggaggttaggttaagttttttgtgtgtttttgtatttttttaggtttttgtatttgtaattggtatagagtaataattttaggttgttgggaatgtaagtgtgttttggtggttttgtttttagtttgggttgtagtgttttgagtgtttttttatttgtttgttggttttgtatagtgtaatgatgttagtttgttttgagatttgtatttttgattttgattgtgttagtagtagtggtagtgatttatttggtttttttattgatgaggaagattgtgttagattttaataggtagtttttgttttggggttgtttgtgttggtttgtaggggtgtgtttaatattttttgggtgtttgaggttttaggggtataggatgatgagtaggagaggtggtggtgttgtggttggatgtgggtttgttttgaggtgttgttgtatttgttgtgtaggagttggtgtgttaaggttaatgattgtgagtgtaattgtatgtataatttgaatgtggttttggatgtattgtgtagtgtgttgtttttgttttttgatgatattaagtttattaaaattgagatgttgtgttttgtttataattatatttgggttttggttgagatattgtgtttggtggattaagggttgtttggaggtggtgtttgggagtgttttttgttgttgtagtgtgttttttgtttgtttggttttttaagttttgttagtgatgtggagttttggggtttaggtgttgttgttgtttttttgttttttgattttagtagtttagttgtttttgaagattttatttattgttttggtgattttgtttttttttttttaagtttgtttaaagatttgttttatataatgttttgttttattttttattattaggttttttgtagatattgttatttttttttttttttagttagtaggtaatagatggggttttagttgttgttttgggattttttttttaggtggagggaggaagtgggagttttaaagtagttggggatatttgagttgtttgttaggttgttgtatttttgtggtggatgttttttggtttgtttttttggtttttagtt

SEQ ID NO: 248 - DNA, 159782 bp, Artificial Sequence
  Chemically-Treated DNA
tttttaggtttttggtattagggttaagtttattttgaatttatgttatattagtaggtgaatattgttatattgatatttaaatgtttattatattattttaaggtttttgaagtaggggtaattttatttttagtaaataaaaattagattggataattggaattgtataagttttataaaagtatgttggagttatataatgaaaaagtagatttttttattatgatgtttttttatatttggtattgttgtaaatggttaatatttattgttaatttggtataaatgtgtggtttggtaatattagaatagtaaatttaaatgaaaaaataaaagttaaatatttttatataaggttttatagtttgatattttattgtgtaggtaaaaagatattttttttttaattatagattattatttagtatgaataaaaaattataatttttatttttaaataggagttattggttttaatttttatatattttaaaattattgtgataaaaaataatgaaaaagttttttaataatgttatatatagtataatatagatttgtttttattatatagtatttaatatataaaatagaatattgatatatttgaatttatatgtagttaagtaagttatttgaggagggtatttttatatagttttttattagaaaataaaatttttttagatattttttagagagaagtaaatttttttttgaaaatttggttattaattttgggtggattaggttgtttgaaaatagtttgggaaattatgaaattttatttaaagggtttaaagtgttttttttatatttttattttttttttgatattaaaattagatatatatatataaaaatatatttatttatagttatagttagggagtgattagttaagatggaaattttattgaaggttattatggttttggaagtttgatagattaatgtattgtataataatattttttattttatggtgatgtagtttttagggtttttaaaagggaattaaaattatgagatttaggtgaaattggaattgttttttgtttttgaattttgaagggagtgtggtttttttttatggtatgtttagagtttattttatgttaattatttagtattttatagatataaattatgttagttttttttttggggtggttaaggtttttttttatagttttaggtatttggatatatatattttaaaagtgttatgttttaagtgttttagttttgtttgtatagtattttatagaatatttataaatattaaaaatattttttaggatttgttgtgagtaattaatttttattgaagttattataaattttaatagtttgggttgggatggttagataatatatatataggaaataaatttgtttttaaatagtattattatatagtatttaaatttataattaaatataattaagatgattttttttttttttatgtattttaaaagggtatagtttttttttttatttaatgaaaagttttttatagttgttgatgagtattagttgatttattattgataatgaagtgtatataatttttttttttttattgagttttattttttgagtgttaagattgttgggatgaaaattagattaatgtgtgagatgtgttttttggttttaattatataatattttataaaggaatgataatttatgttttagaagttttttttgaaatttaatattgttattgataagaatatttaagtagtttttttaggtattaaaaatttatttagttgggttatatattattttaaaatattatatttttttttagagagtatttaaaaagtaaatgattgtttttttattaaataatttttttaaaatattgaaaataataaataatatttaaaaagtatttaaagaaaataaaaatatgtttttattttatttggaaataaatttttgttgtaggatagaaaggaattagtgtattattggtaatttatgagattttgtattatttatatattgttggtatttttatgtaaattattgttaaatttttgaagtttttgttgttatttaattgttgggggagggttgtatgtgaaagtaatttgttattagatggtgtttttaaggatgtaagtattatttttttgttttttgtttatatattttatatattttagtgtaaggggagattgagtaaattaaatttgtgttgatagatttattgttggaatgagaagggtggttagaatgggaggtagaggataattttttttgtaattttattgggttagagttttagtaatttttattgtatataggattagtttttatttttttttttttttagagtaaattgtttggtttttgagattattgttgtttgtatgaatgtatgtataaattataaattatataggttatttattagtatttttttgatttttataaaaaatatataatatgttatgataaaataattttatttaaaaattatttttattttatattatataagttattttataattattttaataaattgtatgtaaagttgtagtagtttttttttttttagattagtgaatattaatatgatatatatttgaaattataattaaatataaaaatatattagaagttttatatttttaatattagatttttagttttttattatataaataatttggttattttgaatagaaattaaattttttgtggtttagtaaatatgttaagttttgagtttatagaaagttggtaaggtgtatatagaaagggttattatagtttttattttgtttaaaataatttttaatagtgaagaaatttataggatttgtgttaaattttatggtatatattagggatgtgtagttttataaatatggatgtttgatatatagttttaaattataaaaattagtagttgagtttttttgtattattaggaaagattaattaattggtgatagatgggaatgtgaaaatgggtgtttagttatttttgttatattagagatttagtttttgggtaaagtttagtgagaggaattattttgtttgattaaaagttttttagttgtgttatagttggttatttggaattataatttttaagaagttatataaattattttaaaaggttttgaaagataaatagtttattagtttttttgttatatagttattgtaaaaatagggtgttaggtatagatagggttttttggtagttattttttaaattagttttttgtaattattatttatagtttatttagtaggttattggattaggtgttttatattagttaggattgttaatttgtataatttatataattttttattgaagtagatatatataaaatatgagtttttttttttttttttttgataagaatattggagatttgagttaatttttgtggttttttgatagttaagtgttattaggttagaagtattaatttatttttatatagatgattgattaatgtttagagtttatttgggaaagttatgaattagttgtttattttaaatagttgtataataatttgaataaaaaattatgtaagaaaaaatgagtaagtgtagtttattaaatataaaggaaattgttaaaattagatagtaatagttataaaaggtataattttttttttttgatatatatttgtaaatttttttttaggtttttatgtataaattaaaaatgttattttaattatataggggggggatatattaatagaaagtttagaaaattttatttagttaattgtgaaaaaaagtatgaagagaaagtttattatatagattttgggtattggtggtttaggtgttatttttttttgattgtggagattatgtttatatattaaggtttttaatttttgggatatattaattaataaattttattatttatttttttattattgaaaagtgatgatgatttaattgtttttgttgttaagttttggttttttataaattatatgtagtgtgtatttaaaataaaataatagatgaaaataataaaaaataaaataataaaatttttataggataaattgatagtttatataataaaagttattaatttgattttttttaaggtaattatttttattaaggtagttatttttgatgaaatagaagttttttgatatttttatttgaatattttggtatttgattggtgatgattttagttaatattttggggaatttaatatttatggttttatttaaaaatgtttggaagtaatagttaaggagatttttaattatttgtaagagaagatatggtaatgattaggtttttaaattggttagtgggaatattttatgtttgttgttttttattttgaaaaaattatttggtttagaatatattaattttattggaattttttagatgaaaaataagtatttttgtataaaatatattttatatttttttgattgtatgtagaattatatagaattattttatgaattattgtagtattataatatatgaagggtgtattattttaatttaatggattaattatattttttaaaaatagtattattaaattttgtaataatatggtgattttatatatatatgattaggtgaaaggatattttataattggttttaggaaaaatgtttataaaattgaagtttataagttgaatttaagttattattaatatttataaattgggggtgggggtgggggtgttgttggtatataattatatttattaattaaaatatattttgttttagaaaatttttatatttggttttatgtttgatatttattttatgtatagaatttaagagttttgttagttgataaaattgttgttagttttggttggagttttttttttttttgataatggttttttttagttttttgatgtaggttattttaattttattaaatagtttttggttttttagattgtttttaggaattaaaaggttaagatgaagttagttaaaggatttttttttttttttttttttttttttttttttttttgagatagatagggttttattgtgttatttaggttggagtgtagtggtataattatagtttattggagttttgatttttttggtttaagtgatttttttattttagttttttgagtagttaggattgtaggtataagttattatgtttgagtggtataattatagtttattggagttttgatttttttggtttaagtgatttttttattttagttttttgagtagttaggatataagttattgtgtttggttaaatttttttgtagagataggatttttttatgttgtttaggttggttttaaatttttgggtttaagtaatttttttgttttggttttttaaagtgttaggattataggtgtgagttattatttttagttagattttttgttataattttttatatatgtaagatgggtatttaatattgtttatgtatttttattgtattttaaaatataagtatttttttaggattattaattaaattatagttaagagaaaatgtaggataataaagaattggaggatttaattttgagtaaattatttgattttttatttataaaatggaagtggtgatgatatatttttttttttttagtttataaagttatttggaggattaaatgaaataatatagtgatttttagttaattttgtttgttattttgtatttgagtttaattttagtattgagatagatagaaggttttaataatagtgtttattttagtaattatattttggaatatttgtgatattattagttaattataattttaaaattggtatgtaatattttttttaatgtagttaatagatatgttttagtagggagtaaatatttgtttttttttatgtatatggattttggttagtgaaattagtataaaagttttggggggatatattattttttagaaaatggtattaataaggataaggaatagagggttaattatggttttatttaattttgtggagattaggatttttgtagagtgttatattttttatagtgtgtttttgggaatattgattttgtgttaattatagttagagtgagataaaggatttggtggttaaagtttgagaaaagttaaatgtttaatatatattaggtagatttttgaattttagtattttttggagatataattgtgtattttttagagaggggaaatgtattattttttaaattgaaattttattgttgttgatatttttagaagatgttggtatagaggaaaagttatggatttaggagtttttagaagttttattattattattttttttttgagatagagttttgttgtgttgtttaggttggagtgtattggtatgattttagtttattgttatttttgttttttaggtttaagtaattttgtttattttggttttttaaagtgttgggattttaggtagtaagttattatgtttagttgagtagttttattttttatttgttatgtggatttgaatataatttttttgagtattttttttgtttttttttattggattatgattagaattagattaatgaatatgtatgaaaatgtttgattttataaagtattataagatattagtattaatatgaaaatgaagattgtttaattaggagtgataatggtattttatattaataatgggttaattttatatattattatattatagaaaatttaattattgtaaaattgtaaaatagtgatggtttatagtttttttttttgttgtatagtttttttttttgttggttagttttaattttaaaaataattatggtgaagtttaatttaatatgtatataaaagaattttatttattttaaatttttttttaatgttttaatattgaaattattaatattatttttttttttggttgtaggaagtaagtatagtttggaattttttttttattggaaaattggataataagtaatatatgattatgatttttaggaaaagagaaataaatatggtaagttatatttagtttaggagtaagaaattttaattttaaatttttgtgtttgaaagtaattattatattgtagtgaagggaaagggaatttagggtttagtaattttgttgggttgaggagaaagagattgaagtttggggaggttaaagtagttttaatttatgggttagattattggaaatgaaggaggtatataaagaaaggtttttagaaatttgtataatttatgggttagattattggaaatgaaggaggtatataaagaaaggtttttagaaatttgtataatttatgggttagattattggaaatgaaggaggtatataaagaaaggtttttagaaatttgtatagtttttggttgaataaaaatttgtgtatatttagggtgaaattttttgaggttatagaggaaagaaagatttaattaaatatgttgggtatttagtagagatttaggggttatattttagaagtaaggttaaattagttttagaaaaaaggttatatagattagtggtttttaaaagggagggggagattttgtttttaaggggatatttggtaatgttagagatatagtagataaatttaatattataaatatttttgttttagaattaataagaataaataagatttaaatttgattgatatttttgaaatagtttatttaagaatttgtattttttttaagtatatatagaatattaatttagaatataaaataagtttgaatatatttaggaggattaagttatataatgaatgttgtttgataaaaatgagattaaaatagaagttagtaataaatatatttggagaaaaatttaaatgtttagaatttgatatttaataagttatagattaaataaggtattatgattaaataaggtattataaaattaaaaatttttagtattgaaaatatagtatattaaaatgtgtgggatgtaatgaagatagtgtttagaaaatttatagtattaaaagttttgattagaaaagaaaggttttaattaattatatatgtttttattttaaatataagaaaaatggaaaggataaagagtagaaatgaataattaagaatatgtataaataataataaaattaagattaagttggttttatgaaaatattggtaaaattgaaaaatttttagttagattgattaaaaaaaaaaaaaaaaagtaagaatatattaaatattaatgttgggaatgaaagggaataatattagagatattggagttattagaaggatattatgggaatattatgaataatttaattttatattaataaatttaatatttgaaggaaatagttaaatttttttaaagatgtaaattaataaagtttatttaagaataaatatattattagtaaatatttgatgaatttgtatttgaaaatttttttataaaaaaggttttaaataaattaagatagttttattgttgagttttattaaatgtttaagaaagaaataatattatattattataatattaaagttatagaatatattttttatggatttagatgtaaaaatattaaaattttagtataatgaatttagttatatgtaaaaaggatattatattataattaaataggatttatttttggaatgaaaggttagttaattatttagaaattaaatagtatattatattattatattatattagtgattaaaaatgaaaaatatatgattttgaggtataaaagtatatgataaaagttttttttgttattatgaataatgttgttatgaatatgggtagttattaaatgtatggtaagttataagggttaattatatattttttaggatagtgataataaaaaaattatattaagttttggtaaggatgtagataaagttgtaggatttagaataattagatagaaaattagtaaagatatagaaaatttgaattagtttattaattaatttgatttaattgatgtttataaaattttatttaataagagtatagtaagtttttttttaagtatttatggaatatttaggatagattatatgtaagtgtttaaaaaagttttagaagatttattggagttatttaatattagagttttttaatgtattttttattttagtggaattaaattagaaatgaataggaagagatatggaaaatttttaaatatataaaaattaagtaatatatatgggttaatgaaaaaaattatgaaggatattagaaaatgaaatgaatgaaaatatataaaaaatgtatagttttaaatatttatataagaaaataaggtttttaattaataatggaagtttttattttaaattagaaaaagaggaataaattaaatgaaaagtaagtagaaaagaagaaataataattaatgatataggaaataaaaagagaaaattaatgaaattaaaaattttaatgaaattaaaaattggttttttgtaaagattaataaaattgataaatttttaattagattgattatgaaaaaaagatgattaggtataaattatgaaaatttataatggaggggatatttttatggattttataaaatttaaaggattataaataattttatgtttaagttagataatttagataaaatggtttattttatagaaatatataaattataaaattatgttaaggaaaaatataaattttgaatagatttatataataaataagtaaataattaaaaattttttttgaaagaaaatatagatttagatggttttattggtaatatgtattaaatatttaaagaataaataagattaatattttataaattttttaagaaaatagaaaatattttttaatttattttaagaggttagtattattttggtagtaaagttagaaaaagatattataagaaaagaaagttgtagattagtattttttataaagagagatataaaaatgattagtaaaatattagtaaattaaatttaaaatatatatggaaaagattatatattatgatttagttagaaaattagattttaaattattttaagttatttttttgattttgtaaataaatttgtattagaatataagtatttatatattgtatatagttgtttttttgttatagttgtagaattgagaaattgtaatagggattatatggtttataaagataaatatgtattgtgagtttttttatagaagattatttgtggaattatattttgtttagtagtattttagtagtatttttggaaagaggatttgatggtttttttatttttttaaagttggaatttttatttttttttaataattggaatttttttttttttttttggagatggagttttattttgttgtttaggttggagtatagtggtataattttggtttattgtaatttttgttttttagatttaagtgatttttttgttttagttttttgagtagttgggattataggtatgtgttattatgtttggttaatttttttgtatttttagtagagatagggttttattatgttggttaggttggttttgaatttttgatttgatgatttgtttattttggttttttaatgtgttggaattataggtgtgagttatagtgtttggttagaaattggaaatttaagatgttaattatttttaaatggatttatagatttaaggttattttaataaaaattttattagattgtgtttttgagatagagttttattttgttgtttaggttagagtgtattggtatgattatggtttattgtagttttgatttttttttttagttttttgggtagttgggattataggtataagttattatgtttggttaattttttttattttgtgtagtgatagggttttgatattttgtttaggttggttttaaatttttgggtttaagtgatttgtttgttttggttttttaaagtggtggaattataggtatgaattattatatttagttttaaaagattttttggtagagattgttaagttaattaaaaaatatgtggaagattaggtatagtggtttatgtttgtaattttagtattttgggaggttgaggtgggtggattatttgaggttagggtttgagattagtttggttaatatggtgaaattttgtttttattaaaaatataaaaattagttaagtatgatggtgggtgtttgtaattttattgttggggaggttgaggttgtgatgagttaagattatgttattgtattttagtttgggtaataatagtgagattttattttaaaaaaaaaaaaaaaaaaggaagtggaaatgtaaggaaattagaatatttaaaataatagtttggaaaagaataatagatttggagaatttatattattaaattttaagatttattgtaatgtaatagtaattaagatagggtgttattaatatgaatataggtatatagattattgggtaagaaatatagattgttgggtaagaaaaagagtttgaaagtagatttatatatatataaataattgattttttataaaattgttaagtaatttaatagggaaaagagagttaagttttggagtaattagatatggattttggggaagaaaatgaattttgttttttattttgtattatatatttaagtatgtgagttgaaattatagaatttttataagaaaataaatagtagaaaatttttttaattttggattaagtaaaatttttttagtaaataaagatatgaagttttttttaaaattatatatttttgtttatttttatatttttttaagaaaattgtaaatgtaatttatttaaagaaaatatgtaaaatatatatttaataaagggttatattgagaatatttgaataatttttaaaatttagttaaaaaatgggtaaaagattaaaagaggtataatattaaataagaaatataggtggttaataagtttatgaaaagatgtttaatatttttaattattagtatatttatgatgaaagaggttgatagtattaagtattgaggaggatatagaatggattttaagaagttttatatatttttggtaaatgttaataattgtggaaaagtttggtaattttaaaaataaatttaaatatatatttaatttatgttttagtgattttatattttagtattgatttaagagagatgaaatgtatatttatatttttatttttttgtttgtttaatttgtaagaaaggtatagtaaaattttattatttttattagatttatttaagtatttttgttttatgaatttttgtattatgtaatttgaaattatatatttataattattttttttgaataaatgttttaaggagtattttgttttaatatttattttgtttggtaataatgtagtttttttggttttgttttggttaatataggggttagtaaattttggtttatgggttaaattttatttgtagtttgtatttgtaaataaagttttattggaatatagttatgtttgttttatttgagtattgttaatgattatgtttttgttataagggtagagtttagtagttgtgatagagattgtgtaaagttaataatatttattatttggttttttatagaaaaagttggttatgttttgggttatattatgtaaagtagatttttttattttagttttttaatatttttatttagatatagttttttttaaatagtataaatttggattatttttaaaattttgttagattagtttggagtatttagtttatttttatatttattttatttttgagatagtgtttttttgttatttagtttggagaagagtggtatgattttggtttattgtaatttttattttttaggtttaaatgatttttgtgttttagttttttgagtagttaggataataggtatgtattattatatttggttttttatagttttagtagagttggggttttgttatgttggttaggttggttttgaatttttgattttaagtgatttgtttatagttttttaaagtgttgggattataggtgtgagttattatatttggttttatttttatatttaatgaaattaaattattgatgtgtttgaatttagttgtattaatgtattttatttgttattttttgttattatgtttttgtttatgtatttttttttttttttttttatgttttttatttttttggattgttttttttaggtattttttttttttaatggtttggtattttgtatattttgtatattttatttttagttgttatttttgaaatttattttagttttattttttagtttttaaggaaattgttattgttgttattttatatatatagtaaatgttagtttaaatgtatttatattatttattatttttgttattttttagttttttttaaagatgggattatttttattattttttttttaagatggagtttttttttgttattaggttggagtgtagtggtgttattttggttttttgtaatttttatgttttaggtttaagtgatttttttgttttagttttttgagtagttgggattataggtgtgtattattatttttagttaagttttgtatttttagtagagatggggttttattatgtaagttaggatggttttgattttttgattttgtgatttgtttgttttagttttttaaagtgttgggattattggtgtgagttattatgtttggttgggatatattttttaataattttttagtgagtatttggtggtaaattttatttttattttttagttaaaaaaatagttgattggtgtatttagagtatttaaatttaaagtaattattgatatagttggattaatgtttattatgtttatattgtatttgagtttgggggaattttttttgatttatttatttttaagtttattgattttttgtttggttgtgtttagtttattgatgagtttattaatattattttgtatttttttatagtattttttagtatttatttttagagtttttatttttttgtgtatattattttttgtatgttgtttatttttttttattggagtttttaatttattaattataggtattgtaaattttttatttgataattgaaatatttgtgttatatttgaggattgtttttgatgtttgttttgtttttttagattgtgggttttttttgttttttagtatgttttgtagtttttttgttgaaagttggatatgattgatatattaaaattgaagtaattagatttttagtgtgaggttttatgttaatttggttaggagttgggttgtatttaatgtttgttataattgtaggtattggaggttttagttttttttagtttttttgtttttatttatttttttttttgttgtttttgggttttttaagagttttttaaatagtttgtgttttgtagtttttttagttgtaatttattgttattttattttggagttttgtttatatggtggtaaggtgttggggagggggaggggaattgttttttaatttttatgattaaattttagttttttttagtgggtttgaatttttgggttgtgatttttagaaatgagataagaaggttaaggaagggttagaattttttatttgttttttttttaggttatataagggtttgttgaattagttttttttatagggtaggttttttgttgtgaatattttgttatgtatttttaaattttattttttttttatttttattagaaaaaggagggaattttttttgtatttttattataagaattttgtggagtttttggaagttagaaattttgtggggtaaatttaagaaattgtaggaaatttttattaagattgggtttttgggagtttttaattttgaagttagtttttatttagtttttagtaatttattaaaattgttatagtttttttggttttagtggtatttttttttaaattgttatagtttttttggttttagtggtatttttttttagtaagttgattttggttgtttttttgtatttgtttatttttttagattttgaagtggtggtttgttttatgatttttattttttgagggatttaagaaaagttattgtttttttagtttttatagttttgttgttatttttttgttgtgatttttagtatttatagattttttttgtggtttatatatataaatatatatataattattaaaaataattgtatttttttgtttttagatttatttattgtttttttaattgtatttatatttttattttttgtttttaaatttattaaatatatagaattagtttaaatgtttattaattaatgagtggataaagaaaatgtggtatatatatattatggaatattatttagttataaaaaggaataaaataatggtatttgtagtaatttggatggaattggaaattattattgtaagtgaagtaatttaggaatgggaaattaaatattgtatgtttttatttttaagtgggagttaaattatgaagatgtaaaggtatgagaatgatattatggattttgtggattagggttggggaggggatgagggatgaaagattatatattgggtatagtgtatattgtttgggtgatgggtgtattaaaattttagaaattattattaaagaatttatttatgtaatttattattatttgttttttaaaaatttattgaaattattttaaaaaagattataaatttaaaaaaattttaatttattaaatttattaatttattaggttttataaatgttgttaaagagtaagttggtttgagttttatttatttttgtaggtttttgtttttatttagtttttaatttttttagtttagtatttttggtgggaggttatatatttattttagtagtttattatagtagaagtttatattttaaggtatatatttttatttttatgattttattattttttaataagaagaatttgtgatattatttataatgaaaaaaattatatagtttaattagtttgggatgtatataattgaaattatttttttttttttttttttaaataagtaaagttgttagtatttaggtattgaattatatttttatggtattaattaaagttatgattagaattttatgtaattgtttaattatttttttaataagtgtattgttataggtaatattaaatgtttttagtaatgatttttattgggtttttttgttttgattgaaatattattaatattttttatatttattaatataaaataattttttgttgagtaaaaatagtgtgaaaatattaagatgaatgtgtgttttggaaatgtttaaatagatatgaaatgattaaataaaattatagttttgtgtaatatttatagtttatagttatttggtaattatgaaattatagttattaatggaattaagattttttaaaaaattgtaaatgtatttatttgtatatgaaagaggtatttagttattaatttagtatttaataaatattgatatgtaatttttatttgaaatggtttaaggtttataatattaattagtttatagagttttttttaaaaaagattttttttagagtagttttaagtttatagtaaaattgggaggaaggtatagagattttttatatattttttgttttatatattattatttaaagtttatagttgagggtttatttttggtggtggatattttttgggtttggataaatgtataatgatatgtttttattattgtagtattatatgaagtatttttattgttttaaaaattttttgtgttttgtatatttattttttttttttttttaaattttggtaattgttgatttttttttgttgtttttatagttttgttttttatggaatgttatatagttagaattatatagtatgtagtttttttagattagttttttttatttagtaatatgtatttaatgtttttttatgtgtttttatggtttgatagtttatttttttttagtttttaatagtattttattatttggatgtattatagtttattattttatttattgaaggatatttttgtttttgttagttaaaaagtaattttatagaagtttgttttataaatttttgttgttattttttagataatgaatttttgataatttagtttttatgttatgttaattaatttttaatagtaattaagtatattttttttaggatgtgttttttttttttataattttttatatatgttaatatttattaggaaattaaaatttttaattaaataatagtgtagtggataaaattattgtagttagttttttttttttatgtttttttatgattaaagattaaaggaaggaaggagaaaaaagtttatatagatttttattaatagagatttttatgtagtttatatatttttttgtttttgttatatttatttgttttattaattttggtgttatttattgtgtttttttaatattttatatttataaaaattatttgattagtaggaaataatagtagatttggtataattattagtattatgtatataaattaatttttgtttttaggtttttatattttatgtttttgatataaggtgaaaaggtgttttattaatttgaagagagaagtagtaaggtttttatatagagatattttttataagatatttgaagtttgtgtaatttagaggaaatatatagtatgtgtttatattggttgtatatgtagggtagagttattttttgtttgtgaaagataaatagtagggtattagttagaaatattgttatttttttttaaaaagtatatttttgttttgttttgtaaaattatgaatttataaagaaaaataattattgtaataatattattgttaattttttataaaattagaattttggagaattttttttaaattttttgtattttggttgtttaaatagattaatgaataatttaatgtaatagtggagatattattttttattatgtatgttatgtattattttattatttaattaaagtgttagaatttttatagaatttattattagttgtttatttaaattaaggtttattatttgaatatggttaattagatgatagttttaggttttatatatttgatttttaaaggtaaatttttttatagtagtttattttaaagataaaaatgtgtgatattgtttatagttatgtagagggtgagatttagaatttgattttagatttttgatgtttaaaatttgtttttgataggtatatgttttaatattttttaaattaaaggtattaaattaatttttgtttatgattttgaagttattatatatttatgatttttaaataggtttttaaagttttttgatttgtgaaatgatattaagagtttgaaattgggtttagtttatagtttttaaaatgttttaagatttttttttttttttaagtttttgatagaaagttgttttggatttaataatagaaaggttattatttttttttattgaatatgtggtttatttttttatataaaataaattagatatgatttatatgttgttaaagtgattagaggttttttaaatttaaaatttgtttttattgaagaggtatttttttagtttttaatagtaggtaaagtattttttttttgggaggtattttttttttttttagttttttgtatatggttatatttatataattgaaaattttaataaagttatagtgtagtagaataagtaaaaatttatttttgttggttgtaaaaataataataattttttttttttttataatgttttgatttaagggtaattatgagagattgtttgatagttttatagagggttagaatttgaatgtatattttttgatatgtaatatttgtttgttatagatattagagtagtatggaaatatagtgggttaagaaaaaagggtggagggttgggtgtggtggtttatatttgtaattttagtattttgggaggttaaagtgggtggattatttgaggttaggagtttaagattagtttggttaatatggtaaaattttgtttttattaaaaatataaaaaattagttaagtgtggtggagtgtgtttgtaattttagttatttgggaggttgaggtagagaattatttgaattttggaggtagaggttgttatgagttaagattatattattgtatttgagtttgggtgatagagtaagatttgttttaaaaaaaaaaaaaaaaaaaaagaaaagaaaaaggtggaggattgtttattttttaggtagtagtatgagaatataagaataggaagtatatattttttaatgaaaatgaaattaatgtaaatttgttgaggaaaaaaaattataaattttattttatgtaaggaatgtatgtggtatgattagattttgttgtgattgtttaaagttaaatttgaatgttttaataataaaaattttaaattaggttagttttataaattaggataagttggtgttttatataaatttgtttatgtttttaattttatttaaatgtttttaaattatatattagaaagtgattaaaaaataaatattgttaatatggtattttttaaatagtatggtaggattatgatgagtaataatgtttttagtttttttagaaattaaatatatttattagttaatttaaaattggatttaattatttaattttgttatattgtgatgtagtagtttgaatagttttttttttggtaataaaagttaaggtgatttttgttttttatataaatagaaattttttttattttttattttttttagattaggggtatgtgtgtgtgaattttttgtttatattgtattaatagtaataagttaggggtatgaaaagtagtaatataaggtagaaagtgagagtaattaggatgtgatttttttgttgtgtatttggtgatgtgaatattaagagtttaagagtatgttggaaaggatggatgggaatgaagagtgtgtgaaggaaaataatgggagaggaagtgaggttagattttggaaagtttgaaattatgtagaatatgtattggagggttagtgggaagatattgaagataatttgtgtattggggagatatgtgatgtagttagattgtgtttgaggaagtaaatattagttaatatgatgaatgttatattggagggagaaaatgagtgaggaaataattgtaatgaggtaaggggaaatggatatttgaagtattttgtagatataggaataagtttagaggataagagaatagttgatttataaaattttaaaggtttggtttttttttagttaaataaaataaatttgtttttatatttttaaattatagatattgggtgagttttgttatgtaaagagatattttttgtgtttgggtttatatgttttattttattagtttagatatttttatttataattgtttttattgaatttatatgagttttattatgtttttttttttttttggaatagggttatgtaaatgatattatagtaagattttttgttgtttgtgatagattttattaattttagatatgttgttaaatatttttaaatatgttttgggatagtaataatgttatatgtatatttgttttatattatatttgttttgttttaagtatttataattttatttttagtttgtttagattttagatatttagtaggattgttttagttttgaattattataatagtagttaattaggaaaatattagttggttaaagatattttatgaatatagggaaaatgatatatatataatttatttattaataattagattaggagtaaaatatagtaggtttgtatttgattgtttatatgatttttattttagagtaaatgttataagaaatatttaggagtattgtagtagggttatttggttatttaggtgtaagtttttgaaatttgaattaagagaaataaaggtatgaggtaatattttttagaagattatttttgtgggaattgttaaggagtaatgagattaattagttttgttaaaataagggtatttttaatagaaaatggaaattaaatattaggtagatatagtttttttttgttatttgatattttaagatttataaatttttttgtgtttttttttttttttttttttttaattgagataaagttttgttttgttatttaggttggagtgtaatggtgttattttggtttattgtaatttttgttttttgggtttaagtgatttttagtgttagttttttaagtagttaggaatatagatttatattattatgtttggttaatttttgtaattttagtagagatggggttttgttatgttggttaggttggttttgaatttttgattttaattgatttatttatttgggttttttaaagtgttgggattataggtgtgagttattgtatttagttttttaggtgttttttaatagtttttaatgtaaaaaaaaaaaaaaaaagttagttttgttatttttgtttgtttaagtaaatatgaattaaatagtaaaatagttaaaatttttggtttggtggttattagtgattgggaaagatagtggtgatggggatgaagtgggaatggttgatgggtgtaaaaatatagttagaagaaataagttttagtgtttagtagtataataggatgattatagttaataataatttattttatattttaaaatagttaaaagagaagatttggaatgttttttaaataaatgtttgaggtgatggatattttagttattttgatttgatttttatatgttgtatgtttttattaaattattatatgtattttttaaatataaatatgtatagtaaatatgtataattattatgtattgattttaaaaaatagaaaagaattttggtttgaggtattaattaatgagttaagtaaaatatttgttttgttatttatattttttttttttttaataaaataaggatgataggaggttaggttatttttttgttttttttttaattatttgtgtgaatataggtttgttaattttttgtttttaaagttagagttgatattaatattgatttttgttattttatattaaattttaatagggtaatttttatttaaaattatttttaaaattatatttaatgtgtagtattttatttagtgaagggttaaaattattttattttagtataaattttgataattaatatatttgatgtttattaattttataaataatttgatttttaaaagtggtataatgaaggaaaataaatggaattaattaaaaatattttttttttttaaattttagtgtaaaaggagttttgagtgagttttgtaatttgaattttgatattatattattttatgtgaaattattattttgtgtataatgatttgaaaagtagggagtaatgtaaatgttttattataaattttttattatttgtatttatttgatttttttttttatagtttttagaattaagagaaataagataagttatgggtttatgatgatataaaagttaaagtgtttttgttgaagaaaatataaaggtttatatagttgtttttttatgttttgtattttatttggtattgtttttgtttattttattgttgtaattatttgttgtttttttaatatgttgagtgtagttatgattttttaagttgagtttggaatagagttattatattttgtatataatattttaggtttaataatttttaatagtgatattagggtaggggtgagttgtggtaatgttgtaggaattattgttttgttattaggatttttagaggttttttgtgagatttttgtagtggtttgttgaattttttttatttttttttttgttttttgagttgtgggtatttaaataaatatatagaaatgaattgtaatgggaaggtttgtgttatatagtttatttaagaagtatttttattttttaaaattattaagatgggagaaatattttatttagtaattatgataaagtgatatggaaaaggagaaaaaatttttttttttttgaaagtaaaagatttagaggaatttatttttaattaattttgtttataaataggttagaaattttattagagttattttttatataaagtattataatggtatgttaaaataatttgagtaaataatttttgtaaatttttttataaattatttttttattttatttttattttaaatgtaataattttattggttatataaggtaaattatttttattataaattgaaaaaaaaatttaagtttggagtaatggattataaattgtggtttaagattaatttaaattatggtagtatatataatgaagagaattatattatttatatttgtttaaagttatttataaagataggaagatgatagtagattatatgttaaaaatagtattagttttattagtagaaaaaatttattttttatttttatataggtattaatataaatattgtgtgggattaaaaatatttgggaagatgaaatgaaaaattttatattatataaattataagtgggaaattttttttttataaggaagatttatattgattattttataaatttaaagtagttatttttatattatatataaattattttttattttgatttggtatggaattatttatttaaattataatatggattttgtagattttttagtagatttatttatatttttgaagttattttagtgattaaataaataagaattatattgtttttttagagggaaagtatttagaattttagggaaaggtaagaaatgtaatttatattatgaagaaatgtatttgtttaaattattagggatgtaaattattttgtaaagggaagagtaaatgtaaattatttttaaaaattatttttagattttttgtttttaaaatgatatattatatagtttatggaggatagatatggtggtgggaatgatattttaatgtataatgttagaatagaatggttttatttttattgtgttttatattaaatggggtaattgagaattgtaaaaatttttattaatagtttaaaatagaaatagaattatgatagaattatgttaattagtttattatgtttttttggaggtatagtatgatataggattaaagggtagaaatttgaaattagtatatttggatttaagttttggttttgttatgttgtagttggatatttgtgtaagttattttttgattttttatttttttttttgtaaaatgaggataatattagtttttattttatagggttgttgtgagaattaaatatgtaaaatgtttagaatagtttttggtatatattatagtaagtattatataataattattattattttaatttgtaggagaatatgtttttagaatattttaaatttggatattataatttaatagaggagtgataaaattttaaaaaggaaagatattaatatataaagaaattttttaaataattagaagtattttagtgaaattttgatttaaaattataaaatgtatttttgttgataatgtaaaagagaatatatatgtgttaaattaatatattgaaatagtattttgatagttttaattagttataattttaaatggtttggaatgtatatttttttattttatattagaataaggaagaaagagtaataagttggaggattaaaaaaaaatattttttatgatttagtttgtaattaattttttattatttatatatagttttaaatgagaaaattgatgttttttaatatagtttagaaagtataattgaatttaattgtgttgtattgattagagtaagaaataatattaattaattttttaaaatatttttaggaaggagttaattgaattgaattatttagttaagtaattattattttaaagtaatttagttaatataattttatataaatttttgatttattggagtatatagttgattagtagttaatataggagttttatagaagtgtttatgagtttgtggtaatattattttttttttaatgaaagtagagaaattttaattagtttaaaatttagtttataaaagttggttatttgaaaggataaataagattgatagattattagtaagattaataaagaaaaaaagagtgaagatttaaataagtataataaaaaatgtaaaagatgatattataagagattttatagaagtgaaaaagatttttatattattataagtatttttatgtatataaagtagataatttagaggaaatggataaattggaataaaggttttaaaaaatttagggtttatgtgtgtgtgtatgtgggtgggggggtgggtggagtttattatgaaagtattatttttgtttttagttgatttttgtatatataaagttattatttggagtaagtatgtatgtggaaatggaaatatataatttgtttagattgaattaggaagaaattgaaattttgaatagattaataatgagttttgaaattgaattaataataaaaaatttattaattaaaaaaagtttttgattagatggatttatagttaaattttattagatgtataaagaagagttggtattaattttattaaaattattttaaaaaagtaatttagaaagagggttttatttttaatttattttataagggaaatattattttaatattaaaatttggtagagaaataataataataataaaattataggttaatatttttgatgaatatagatataaaaatttttaataaaatattagtaaattgaatttagttgtatattaaaaagttaatttattataattaagtaggttttatttttgggatgtaaggtttgtttaatatatgtaaattaataaatgtgatttattatataataaaaaaaataatgattattttaatagatgtagaaaaagttgtgataaaatttagtatttttttatgataaaaatttttattaaattaggtattgaaggaatatattttaaagtaataaagagttttgtatgataaattaatagttaatattatattaaatgggtaaaagttggaagtattttttttaatgtaataagataaggatgtttaatgttattattttaatttaatatagtattggaaattttagttagaataattaggtaagagaaagagataaaaggtttttaaataggaaaataaataattaaatgatttttttttatttatgattttatatttagaaaattttgaagattttgttaaaaggtttttggagttgataaataattttggtaaaggtttaggatttaaaattaatgtataaaaattagtagtatttttatatattagtaatgtttaagttgagagttaaattaagaatgtaattttatttgtaatagttataaaaagagtaaaatatttaggaatgtatttaagttagtttaaaatttttataaggagaattataaaatattgttgaaagaaattaaagatgatataaataaatggaataatattttatgtttatggattggtagaattagtatagttaaaatggttatattatttaaagtaatttatagatttaatattatttttattaaattataatgttattttttatagaattagtaaaaagtattttaaaatttttatggaattaaaaaatgttttaaatagttaaagtaattttaagtaaaaagaataaagttggtaatattatattattttaaattaaattatattataggttatagtaattgaaatagtatggtattggtaaaaaaaaattatatataatggtatagaatagagtttagaaataaagatatatatttatagttatgtaatttatataaagttgataaaaataagttatagggaaaagattttttattttattaatggtgttgggataattggttatttatgtgtagaagaatgaaattggatttttatttattgttatataaaaattagtaaggtggattaaagatgtaaatgtaagattttaaattatgaaaattttagaagaaaatttaggaaataatttttttgatattggttttgggaaagaatttatgattaatttttaaaagaaattgtaataaaaataaaaattgataatgggatttaattaaagagtttttgtaaattaagagaaattattataatttatagaatgggagaaaatatttgtaaattatgtatttgataaagttttaatatttagagtttatatggaatttaaattaataagtaaaaataattttattaaaaatgggtaaaggatatgaatagatattttttaaaaaaagatatatgtgtggttaataaatatatggaaaaatgttgattgttaattattagagaaatgtaagttaaaattataatgatattattgtggaaagaagtttggagattttttaaagaattaagagtttaattattatttaatttagtaattttattgttgggaatatatttaaagaaaaataaattattttattaaaaagatatatgtatttatatgtttattgtagtatggtttgtaatagtaaagatatggaattaatttaggtgtttattaatagtggattggataaagaaaatgtggtatttatatgttatggaatattatgtggttataaaaagaatgaaattatgttttttgtagtaatatggatgtagtaggtggttagtattttatatgaattaatgtagaaaaataaatattatgtttttatttataaatgggagttaaatattgagtatatatagatataaagatgggaatagatattgggaaatataagaggggggatagaggaagggaggtataggttaaaaagtatttgttaggtattgtgtttattttttagatgaaaggtttaattatattttaaatattggtattatataatgtattttagtaataaatttgtatatgtatttttagaatttaaaataaaagttgaaaataagagagaaattattagattgggtttttgaatttaaaaaaattagttttagtaatatttggttataaatttgataatgttataagattaagttttatttgattgtttatattaaaaataaagttatattttggattgattataatatattttaaaatgaagtgaataaaaatatttagttttaagagaaaaataagtaagttttttaaaaaaaaatatttaggattattattaaaaattttatttgtttttaaatgttaggttttttaagtagtgaaggttatttttttaaaataaattttgagatttatttggtatggggtaagagtataaaaatatattatttggagttttaagttatatttatggagagatttgggtaaagttattttggggttattattgaaattgtttggtttaggggaagtattttgatgaataagagaatatttttgaaggttgttaaaaaaaaagtgtgaaatatatggtttatttgtattgtaagtgttagggtttgttaaagatttttggtatatgtatatattaggttaaataaagattttatgtatattgaggttagtttaatataaaaatgatagttttatagtgaaattatatatataaattttaagaatttttttaagttttttttttaatttatttataagtagaattggattatttatatgatatgtgttatatggtatatattatagtaggaaataataaattagaatttttttttattatgtagtataaaaatggatataaagtaaattatggttttatttaaaggtgtttttaataattagggtttaaaaagtagaagaatgtatattaaagattaatatgtagtagtttttaataaatgttaatttttatattaattggatatgttatattgattataaaagtatataattggttatttttaatataatattttgagaaattgtagtttaaattgtatgtttaaattttttttttttttttttttttttttttttttttttttttgagatggagttttgttttgttgtttaggttggagtgtagtggtgtgattttggtttattgtaagttttaatttttgggttgatgttatttttttgttttagttttttgagtagttgggattataggtgtttgttattatgtttggttaattttttgtatttttagtagagatggggttttattgtgttagttaggatagttttgattttttgattttgtgatttatttgtttaggttttttaaagtgttgggattataggtatgagttattgtgtttaattgtatgtttaaattttatttatgtaagaaaaatttttgatgtttaataaaagatttaattggaaatggtagtgatggtataattaatagaaaaattagatgttagttattgtttggggttgttttttagtatagtaagggtaaagggtattgtaattgttattaaattgtaagaaggaggaaaaaatggatagattttgtagtttagtttattaaaattattattttgtagttgatatatttttttttttttgatgaaagaaggtttttatagtttggatagggagaaattgtttagaaaaatattatatatttaaaattttaaagattttaaattttatatgtatttagaaaagtatttaaaaatgttattgggtaagtaattataatatattagagatatgatagaattttatttgggtttgttttttgagttttatttaaaatttattttgaaatataaaataggtaaaatgaaaaaatgaagattagagataattgggattggagaaaataaattaaagggtattaaaaatttaagtgttttaatatatatttaaatggttaaagtatattatatatataggagattagagagtagtaagatgaaattgggtaaaatttgggtagagatttggtatttaagaaagtggggaatattgtttttataataaaaataaattatttttgtggaattgaaagtaaatttttgtgtgtattttttagttaatttttatagtttttataatatttataagaaagtgggtagttattattttatgtaaattaatgtttaatatgttgatattttgtagttaagtttaaatagtttggttaaatgtagatagagttgtgtgtgtggtttggggaattagattttttatagttatatttataaatttattttttatttaataagatgtttatatatagtgtgtgttagatagtattaataattagttttttttattaaaagaattatataggttagttgtagtggtttatatttgtaatattagtattttgggaggttatgttgggaggattatttaaggttaggagttagatattagtttgggaatatagtaagatttttttgtttttataaaaaattaaaataaaaattaaaaaaaaattagttgggtatggtagtgtatatttgtagttttattgggtgggaagatggtttgagtttaggagtttaaggttgtagtgagttatgtttatgttattgtattttagtttgggtgataagagttagattttgtttttaaaataataataattattataattataaaaggaattatatggtttttatttttttttagtattgttattttttatttggaggattgttatatttatttaattggtttttttatgtaagattagtttttgtaaaatataaatttgattatgtttttgtttttattttttatttatttaatttttatttagtttatagatttaaaatttaatgttattttttttttgatttttaagatagaattaggtgattttttttttgtttttgtggttttatgttttttatggtgtgttatgttattttgtgattgattttgtaatttaattagtagataaattatttgaatataggtattattttatttattttatatttagtgattgttttgttggtgtatatttgttgaataaaagtgttaattttataataaatattaagtatatgtgttatgagattattattatttttatagaatttgtaattttaattatagtagaattttaaattttttttagaggaaaattttttaatgttgagattagtgttaattatataatttgttatataaatagggatatgaaattttaatttataattagttttaggtttttttttttttttttttttttaagatggagttttgttttgttgttaagttggagtatagtggtgtgattttggtttattgtaatttttgttttttgggtttaagtgatttttttgttttagttttttgagtagttgggattataggtgatattattatgttttgttaatttttgtgtttttagtagagatagggttttattatgttagttaggatgattttgattttttgattttgtgatttgtttgttttggttttttaaagtgtggggagattaagaaatttttttagaaattttttattgttgtgtgtatttaggttatggagttgaatgttttttttgattgagtagttttttaaatatttattttatagaatttgtaagtggatatttggagtgttttgaggtttatggtggaaaaggtaatatttttatataaaaattagatagaaggatttttataaattttggggattataggtgtgagttattgtatttggtttaggttttttttttatttgaaaattaaaataaaatttatttagtttttttttgaggtttttttttttttattattttttgtttgaagatttgtaataaaatatagatttttaagtaaaaggtatgtttttaaaaggtaaatagaaaaatggatatgtaaatatgtttgatatagaaatatttttaattttagggaatagttttgaggttgaaaaaaggagtaagaataataaagttgttgtatgttgtgtaagttttattattatataattttttttttttgtatatagtttggttgtattgaatttagtgtgtgtaagaagaattggtggataaataaataatatgatatatttatgaaaaaaattttttatttttattgggtagtaatattatgttagttaagtatatatatattgaattgattatattaattatatttgtttatgtgtatttttaaaagtaaaatgataaatttttataagttatagagataaataattgtttttagatatttatattattttttaggtttattttagtttgaagatatttttgatagtggtatgttgggtagttttttttttgaattttattgatgatgtaattattttttttagtatataggtaattgtgttgttttatatggaataaaaggtattattaaagttttataggtttttaaatatattttataaggatagtttttgtttttgtttttggtggaatataattaagatatttataggtattgttttgagggaatgtttttgtttatattgttattatgaggttgagaggttaaaaataataaaaagagtttttttttttttgtttaataaattgaaaatagtgtaataaaaaattttattgtagtatttatatataaaaaaagtatataaattagtgaattatttaataaatttttataaattaagaatttttatgtaattagtttttagattaagaaatagaatagtattttaataggttttttttttgtttaattttagttagtatttattaagggtaattatttttttgataaattgtgttttatatagtttgatagattatgtttttttatttttatttttttgagatggagttttgttttgttgtttaggttgggagtgtagtagtgtagtggtatgattttattgtaatttttgttttttaggtttaagtaatttttttggtttagatttttgagtagttgggattataggtgtatgttattatgtttggttaatttttatatttttagtagagatagggttttattatgttggttaggattgttttgattttaggattttgtgatttatttgttttggttttttgatgtgttgggattataggtatgagttattatgtttagttaatagattgtgttttaaataaataatagtttggggtagatggttaattgtattaggtttaattttttgtaaagaataggttataaaattgattattagattataatttatttttgtttagagttgttttttaatgttaaatatttgtattagttgttttaatttttttttgtattttataaatattttagtttttttatttggatagaaaatggaagtattaatttaattttattttttataaattaaaagtatgattaatagatatatttattgatgaagtggttataatataaaaaagttatattttataaggaatttttaaattattgttttatagttattggaagaaaaaaagaaaaaaaattatttattgttaaaaatgaaaaattttaaagttttgtttatatttaattgaaatgttaggatgtgtatattatgttaattttgatttttttattttaggtatgttttgtgtatagttaagattttgagttataggattagaggtaatgtatttttataagttaaaaatagttttttgtggttattagtatgaagttggataagtttatttatttgttttttatttataaaatgaggagttttaattagtatttattattttataatatatggttatgtataattaatagttattttttgttaatttatttatttattttttgatttatttatttatttatttttagataagtttttgttatgttgtttaggttggagtatagtggtgtgttatagttttttgtagtttgaattttttgttttagttttttgagtagttgagattataggtgtgatgtttggataatgtttttttttttttttttttttttgtagagatggggttttgttatgttgtttaggttggttttaaattttaggttttaagtaatttttttattttggttttttaaattgttgggataataggtgtgagttatagtgtatagtttattttttttgagttatagtgtttagtttatttttttgttaatttttttgataagataatgagatattttattttggagtttttgtgttttttattatttggtaaattttttttttaattaatagaaagatgagtttttaagttagttgaaattttgtgattttgttttgtttatatggtatttatttttgtggttaaagtttatttttggtaaataattttggttttttatttatggtgggtgtggtagttagttttttaagatggtttttagtgatttttgtttttttgaatgtatggttttgtgtagtttttttttgttttttattaagattggtttgtgtggttaataaaatatggtagaagtgatggtatgttatatgtgaaattagataataaaagataatagttttgttgtattgattatatatttttttggattatttgttatgggggatgtaaattataatgttatttatgttattttatagagattataaggatgttagttttggttagtgtagtagttttatttattgattagagttaaaagtaaagtttatttttgtttagtgtaaagttttgaataaagtgtaataatttgttgatatttatattatattatgttaattttgagggataatttataattttagtaggtattaagaatggagtgttaagtgtaagatatttttaatttataatgggtttatttggaggtaattttattgtaagttgaggagttatattgaatgtgtattatttttttattattataaaagttgaaaaattgttaagttagggattgtttgtattattattattattgtatttatattgtggaaatatttaagtagttaagaaagtgaggagtaaagtgaggatatgaagatgtttttgttttttgtgtatgtgttaagtaatatttattttattaggagtaatgtataaagtagggttgggttttatttttgattttaattaataggtgggattattatattggttaaagttgttatttttgtaatttttgtggtgtaatatgagtaattttataatttgttaatgtattaaaaagtaaaataaaagaaaatgatttatttaatttttatggatatgtaaatataatatgagataaataataataatttttatatagtgaatgaataattgtttttttaaaaaattaatataattagagttttaggttaagttatttttaaattgttttagaaataattaaattatatgataattttttttttagaggagttattggtagtattaggatattttagatttttttttaataaatttgttatggaatgaattttttattttttagggagataatgttgttgttttgttagtagtttgaatttataataaagtaagatttgtgttaatataatatttatatagtgaaattagtttttttaaaatattttttttgatttttttaggttgagttttttttttttttatttatattataatttttgtattttgttattgttaatttattttttattttagtggagtgtgattttttagagggtaaggattaggttttattggtatttatattatttagtatagtgttttggtttaatagaaaaaaaaaatgaataagaaatgaaatgaatatttttttttttttttgttatagtttttattgtgatttatttttgttaggttagtaaagttggtgattttgaaatttattagtttatggaagttaaagtttatgtttttaatataatgaatattatgttatgtttaaatttaatattattattttatatgatagtatttttttatagtgttattttatgttttttgattaaatttttagatattaatttgtatttttttattttattttagatttttttgtattgttgttttaaatatttttttgtttattagaggatttaggagttatttttttttttttttttaattgatatttagttttttatgggttttgtatataatggaaattttaaaatttattttgagaaatgaaaattaagtagaggaaaaataaattttttaaaatatatattattttttattgtttttttgaagaaaattttatagtttttataagttaagattttataatgatattttgaagttttattagagtatattaggtagagtttgggaggtggttttgttgttgttgttgaggagttggatggaggagagtttatatttggttttatgttggggttaaagaaggggaagaatagtgttatgatttaattgttaaaggaatattaaaatatagtttttttagttttttattttatagttagaatgtttatagtgaattttggttttaagtgttagtaggtattaaaatattttagttaaatatatttaaattatgttatatttttttttaaataaaattaagaatgaggttattttttttgaagtgtttttaaaatagaatggtgtggttttggtttatttttttttttttttttttttttttttagatgtttaggatttatttttataattatgtttattaaggtgttatatatagtaatatttattgttttttaagtttataatttatggtttttgttaaatgaatatttatgtaattattattataattaggagagaggatatttttattattttaaaaagatgttttttatgtttttaattgtttaggttataattttttttttaattttaagattttatataggtattttttaaaatttaattaagtgttattataattttatttatgttttttattagagttaaaatttttttataattttaaagtttttgttttatgtttttaatttttaatgttattttggttgaaattataattttatatgatttagagaagattgatttagaaatattttttataatttttttgtttggtttgtagtaagattggataaagtattaggtttttaaaagtgagttttattttgtttattttattttatgattgtttggtttgaagaagaagatagaaatgtgaatttgttttttttattaggtttttaatattttttatagttttattataaagagtgtaggtttagtgattattagttgtttaaaagataatttgttgttttaaaaatttttaattttaaaaaaaattggaaagaattgtataatggatatatattttttattaatatttattaagttttaatattttgttatatttaatgataaagatatatttttataaattaatgaaatagtgatttttttattattggaggaaaaattaattattgtattttatattatatgatataatggtttttaatgttgtatttttttaaggaattttttttttatgtgttgattttagaattaaaattgtattatgtagttaaaatgattttgtagttttttgtttgtaattagagattgtttattttatttttggttgtgtttttaagtaaatttttaaaaatatggatgttggtaatttgttgattttggaattttatatattaaagtttgttttgtttattatttatataagtttataaatatattagtatttttttttaaattttttttaatttgttttttttttaaaaaagatggaatttagaaataaatttaaattgggtgtttgttgtttttgttattttttattattttttgtttttatttattttagttaataatagtagtaagttttaattataaatatgtttaaattaatttatagagtaaagtaatttaaaatttttttttagttattaatttggttagaaattatatttattaagtaatgtagtttgttgttaatgttttgtttaggaataaaagttaaaaggtaataataatggaatgataattttttttataaatgttattttaagtaattaagttagtaaatttaaatgattgttttaaattttatttttaaatgaagttttttgaattttgttaattgtttgtttatttaataggtttagttaataggatagtatttttattattttaattttgggaaaaggttttagggttttatattgttttttgaatattgttaagaagaatttgtagatgtttttgtattataaggtatttattttttgttagatttgggtgagtggattgattatatgttgaaagtttgtaatagaataatttgaaatgattttgttgtaggtttggtataggttatttttgattaatggaaatttgtgattaatgtagaggagttgttttgggttagagttttttagagaagtaggaaggttttggaatagtgaatggtgtgataatgtgttggggaagtaaaaatttttttggtttttattttgaagatatttttatttttgtttagttagtttttgttatttgatatttatttttagggattaaatagttgtttgtatattagtttatagaaaatgagtgtattgtttaaaggttaggatagtattttgtaatgtttattttattaattatatatatatatatatgtatatatagtatgtatttatattttaaataatagtttgtagtattttgtagttttagtttttaataattttgtgaaaatgatattattatttttggatgtggttatatgggttgtggtaggtggtttattagggagtttatttatggtgaagttgatatattttagattttagttgtattattttatagtttttgttattttgggtaggtatttattattttgatttttgagtttttttattagtaaattgggaaggatattatttgtgtgtgtgttgtgaaaataaggtaatatatagaaaatttattataagtttttgtttttagtaggtatttaatatatgttttttttttttttttaggaatattgaagattttatgagtaagtattatataaatggaaggtagtattaagtttaaattttaggattgtatttttaaatttttagatattataatgtatgtaaaatatgtttaggttatttaattgtaagttatagatgataagggaaagtaaaaatgaataaatggattgatagtatagtagttgaaaatttggaattttaattaggtttttggtatttttttaggtagttgttttgggttatattagataagaattgagtatatggaaagttgttagatgtattatagatattggtgaaaaaagttaatttttgttatataaataggaggagtaagatagtttataatgaatattattggaaaaaatggatgaatgttaaatggtatttagttgtaagtttgatattgttaaaagggttagggtataataaaatggttagaatttaagagaaaattatatggaattgatattttttattaaggatatatggtagaaggaattaaaagtatattatagtaagagtgtatattttattttttttgaatgggaaagttaaaatattttggttttaagggtattattatttgtaatagttattgattgtttaatgtgtgtttatttatagttgtgttaaatattttgagaatgttaagaagttttattatgaattattgttagggtgtttgtttttaagtgaggaatttttggaataaaatgttttgttttaggtgaatatttgaatgttggtggtttttaattagaatggtaaatgtagtagaaattgaataatttttgaggttgagtttatgttagagtttagagagagaaaattatgtataaagttagatatgtttatttagttttgttgtaagtaaagtaattgttataaggaggattatgggtgaaagttatggatggattatgagttaattatatatttagagaagtatgtaaaatgtgtaggtaaattatatttatttatttaggtagatgttttttggtatttgaatgaaaggtaagtattgtgaggatttagtattatgttataaatgataatgaattttgaaattttggtttaggatggagtattagaatattttgtagttgttttttgtgttttagtattattatgaagagaattagttttatatatagataaatttgggtttaaattttagttttagtgttttaatagttgtgatagtggttagttgatttaatttttttgagtttatttttttattagtgttattttagggggtttgtgtggattatatatattagagttatataaagtattgttatatatttggtgattattatataataggtttttattttatttttaaggattattttttttttttttggaggattttagggaaagagaagtgttatagttttttttatgagtttgtagaaggttaatggttttttagaaatttaagtttaggtaattatagattgttttttttgattattatattaaaattggataattttgttttttaaaggttttagtattgtaatgtggaatttaaaattgttattaatgaatttttgattgttatattgaaatatgttagtttattttgtattttgaatgtattttttatttatgtatgattttgtattattatgtattagttatttggaaaatattggtttattgagttatgtagattttttaaatgttgatatagtttattatgtaatataaaagagttatatttgttaagtttatagtggtagatataagtttttaaaaattttgatttttgtttgaaatttatattttattaattggtaataaatattttaagttgttttttttaaagtgttaagtttattttagttatttttgggaaaatattgttaaatatttaaggttgaaaattagagtttattttttatggtattttatgaaaaaaagtaggttaatttatagtttaattttatatatttttttttgagataattattaaatgttatatgtgatataagtggattatgtatttttttattttgttatattgatatgagaaagattatatgtatttaagggttgaaatttaatgtaattaataatttttttgtttttttaaagattttaagtgtatgatagtgaatatagtaattattgtatattaagatgttaatagttttatttatttttgtttttgtattattattgtaaatgttgatataatgaaatggtaaataaagtatgtgttattgtgaaaatagtttgttttttaaggggagatttttagggttttatggattatattggaagaattgttgttatggagattagtaaggtaaagattttaaattagataggttataatttataatttaattttataatgtaatagtttggtgattttttaattttttttaattttaattgttttattgttaataggaatggtaatgtatttgataaaaggatatagtattgtttattaaattagaggtttttttgatagagaaaggggtagagttggtaaattattatttaaatgatatgattggtttagtttttaatttaagtgaattaattagtaattttttagtgtaatgtaagaaatttatttgggagaaaaaaaataaagatattattattttagaaagtaagtgttaatatggaaaaaaattttagaaatatagttgttataattggattaattttttataattattaatagaatatttttattggtttgttagtttttgtttaaatattgtaatatagtagtttttaatagagagtaattttgttttttaggagatatttggtagtgtttgaaaatatttttggttattatggttggggaaatgttattggtatttaagtgagaagaggtgagggatgttgttaattagtttataaggtataggatagtttttattataaagaagtatttagttttaaatgttaataatgttgaggatgagaaaatttggttataaagttttaagtaatataaagtggaaaagaaaaaaaaaaagggattagaaatattttaaaatttaaattatgtttaaaaatgtaataattgtattattgaagtagttttaaatagtttatttaagataagtttaaaaagagatttaaaatagaattgaagttaagttatggattatatggtttagttattaagtataggattggtttgagttagtaatttttttttttttttagtgttagtattaaaaggtagtttttatatattaaagttatttgtattttttttatttttgtttattaggaaaaatgtaaatatttagttgtatatattaggtgattatattttttgattgtttatttatttttgtattagttaaagaattattgatttgtttgataataagttatggaatagtttttaaattaaatagaaaaatgttttaggggaaattttttataatatttttgttaaatggttttagtagaatatattttattttatttaataagttaaagaaagattgattattttttttgttttgtatttattgagagaggtttgtattggttttaattttaggtttttattaagatagtttatttaaattttgtattatttatatttattttttttggggagagggttatagtaataaaatttatatattaatagattaagagaatgtttagtaaaggattttttagatttttaagatattagtggtttattatttagtgtttttgggtttggtttttttgtttgtaaaatgaaggttttgatttaattaattttaaataagttggttatattttgtaagatgggtttggggatggaaaagtggagaggaaaatatttggatttgtaaagggttttttaggttttgtgtatttatttgtagagagaatataattatgttatttatgttatttaaagtttaatttgttttatagaaataatgtattttttttttattggaagaattaatttagtttggttattgtgtttgggtaatttattttttaatagttgtatttttttttgttttttaaattaagtgttaaagatggagaaaaatagaataagttttgagattttaagtattttttttttaggttgtgtgttattagttttgtttgtttaggtttgtattaggggatgtgagttttaagtagaagtaataatagtatattgaatggtaaatagaatattaagaattagtatggtaagaagaaagattaaaaattttttgattgtatagttatttttagaatgaagattggattttgtttttattttatggttttttatatataagagtatataaggataatagatggtttataatttagaattaggaatatgatgtttttagagaaggtaagaatatgttggagataatagtgtagttattgattttttttaataaggtattttgagtatttttgaaatgttatttgtgtttattttaaatataatagtaatttatttttaaatattttatttgatttttaaagagagatttgaattttttttattatatttagtaatttagatttatatgtagagattttgttaattttaatttattttttatattttatttattattttttgtaatattatgttaggatttatttttttttatttattttgattgttgttattttaatgtatgtttttttttattttttgttttaattattgtaatggttgatattaagtagtttttttggtattggtttttttttttattttattttttatatattgttaaaattttttttttaatatgattaaaaatttgaagggtttttttattgtttatagtataagtttagtatggtttataatttggtttttttatttttttagttatatgttttattatttttttatataatttatgtagtttttttattattatagggattttggattttataaatatttattaagtatttatgataggagtagtttttgttaagatttgttttttttgtttgaagtgtttattatggtatttttgatttatgatagtttttagattttttaaaatattgttatatagtattttgtatagatgattttatgttattttttgatgtatatgtattttgtttttattaataattttttttaggtagggtttatgttttgggtttttttatattgttagtattttgtataaagtttagtatatgtttatttattttttttatttatattttttatttttatttgttttgtaaaagaattttgagatagttaatatggtaaatatttatgagattataattagaatataggtataattttattattatttggtattattatgtaagttttttttttgtatagattattttatttaattttttttatagatttaagaggtgggtattatttttagtatttatagatgaagaaataagatttagaaaagttgagttgtttaaagtgatttaagtaattagtaaagttagggtttaaatttaggtttttttgatattaatattagtgtttttaagtaattttttttattttttattatgataaagtgttagaattgagaagttgaggtatatttaggtttttaatttgagaaataatattttttattttgtaggttgaagtttgatgttttgatgatataatgtaaaaaaggtggtaattttttttttgtgtttgtttttaattatgatttgtaaatgaagatttttgtttaaatagggattgttagattaggttaaataggtaaaaatatttgttttaaaattgtgtgatgatttgtgttatttgattaaatttttaaatgttttttaaattaatagatattttatattgtataattagtagtttttaaattttaaaaagatatttataaaaataaatggaaatgtagaatagttgtgtttatatttatattaatataaaggaaggaaaaggaatttttagaattaattttaatttgatttaaagttatattattttttttttttttttaaaggtaaaggtttaattttttaatttttagatttttatattaatttgagaattttttggtttttttgttatgttagtatattagataagttttttttgttatttggattttttttaggttttgatgttgttgtttttattttatatttaggtttttatatatttattgaaataatttaaaggaataattttaggtataggattttttatttatttgtggttttatttttgatagttttaggtatttgtagttaattatagtttgaaaatattaagtggaaaattttagaaataattaataagttttaaattttgtgtaattttgagtaatgaaattttatgttttggaatgtgaattatttttttgtttagtatatttatattggagatgttttttgttggttagttttttattagttatttgtattagttgtttttatattgttgataaagatatatttaaaattgggaagaaaaagaggtttaattggatttatagttttatatggttggggaagttttagaattatggtaggaggtgaaaggtattttttatatggtggtggtaagagaaaaatgaggaagaggtaaaagttttggaaatttttgataaatttatgagattttgttagttttatttattattatgagaatagtataggaaagattagtttttatgatttaattattgtatttttatttttgggttttttttataatatatgggaattttgggatatataatttaagttgagattagggtggggatatagttaaattatattattttatttttggtttttttaaattttatgtttttatattttaaaattaattatgtttttttaatagttttttaaagttttagtttattttagtattaatttagaagtttatagtttaaagttttatttgagataaggttagtaagttttttttgtttatgagtttataaaattaaaagtaagttagttatttttagatataagggttggagggatggggggtagggggtaggggggtgttataggttaaatatagttgttttaaatgggagaaattggttaaaataaaggggttatggggtttatgtaagtttgaaatttagtgagttagttaaattttaaagttttaaaatgattttttttgattttaggttttatatttaggttatgttgatgtaaaagatggatttttatggttttgggtagttttgtttttgtgattttgtagtttattttttggttgtttttataggttggtattgagtgtttgtggtttttttaggtatatggtgtaagttgttggtggatttattattttggggtttggaggatgatggttttttttttatagttttattgggtagtgttttagtagggattttgtgtgagggttttaattttatattttttttttgtattgttttagtaaaggttttttatgatagttttgttttgtagtaatatttttgtttgggtatttaggtgtttttatatgttttttaaaatttaggtagaggtttttaaattttaatttttgatttttgtgtatttataggtttagtattatgtggaagttgttaaggtttggggtttttattttttgaagttatagtttgagttttatattggttttttttagttatagttggagtagttgggatatagggtataaagtttttagtttatatatagtatgaggattgtgggtttggtttatgaaattattttttttttttgggtttttgggtttgtgatgggaagggttgttgtgaaggtttttgatatggttatggagatattttttttatggttttggggattaatattaggttttttgttatttatgtaaatatttgtagttagttttaatttttttttaaaaaatgggtttttttttttaattgtattgttaggttgtaaattttttgaagttttatgttgttttttttttaaaatagaatgtttttaatagtattgaagttattttttgagtgttttgttgtttagaaattttttttattagatattttaaattattttttttaagtttaaagttttataaatttttagggtagaggtaaaatgttgttagtttttttgttaaaatataatatagtaatttttgttttagtttttaaaaagtttttaatatttatttgagattattttagtttggattttattgtttatattattattagtatgttggttaaagttatttaatatgtttttaggaggtttttaatttttttatatttttttgtttttttttgagttttttaaagttttaaagttgtttttatatttttgggtatttttttagtaatatttattttattggtattaatttattgtattagtttatttttatgtttgtgataaagatatatttaaaattgggaataaaaagaggtttaattggatttagagttttatagggttggggaggttttagaattatggtgggaggtaaaaggtattttttatatggtggtggtaaaagaaaaatgaggaagaggtaaaaggggaaatttttgataaatttattagattatgtgagatttattaattattatgagaatagtaagggaaagattagattttgtgatttaattagttttttttgggttttttttataatatataggaattttgggagatataatttatgttgagattttggtgaggatatagttaaattgtattattatttttgttattagttggattgttatagtattatagtgtttgtgtttaagtaatttttattttatttaatggtggttttaaagtataagaatagtgatgttggaatattgttataattgttttattttattattagttattattatttttttattttttttaattagtaggttaaatattaattataggtatgtatgtataggaaaaataatatatatataggatttgggattatttgtggtttgtggttttaagtatatattaggggttttggaatttattttttatgaataaggggtgggggttgttatatttagtaaataatgaaaatattggtaattttatttttagaagattaaggaggaaagaaatagtttttaaaattatataaaagttatatagtagatatttgtaatatagttagttagataaaaaatttaagattgaaaaaagtttttagtaggtgaaataaaatattttttttataataataattatattggaaattattgatttgtaattttgtgtgttaagttgtatgtttaggtatagtatataaataaattattttaaataatttttattgagtttattttatagataagaatataaaaattgggttttttatttgtttaaagttgtattataaggtaatatttggatttgaatttagttttgtttaattttaaaatttatgtattttataattttgtgattgttgtttggtaggggtttgtagagtagtatttattaagtttgatagagttttttaagattatgtgggttatttaatagatagttttaaggtaaggttaaatattaaagttaatttttgttttttatttattttgttttttttattttttatattataatggagtataaattataattaagagatataaaagtatttagttatttttatttttttttttagatatttattatattaagttttaaatgaatatattggtattttaaattattaagataatgttatgttggttattgaaatgttaaattaatatgaagattatattttaaaaatataaaagtataaataggagtgttttgtatatttatattatgatttttgtttttagaggaattttgaagtatattgttatatgtttgattaatgtatttaattttggaatttttggggaagtatttgtttttttttgaaatatattgttttattaaagtattaaattgggtatatatgatgatatgaaaagtattttttaaattatagttaatttaagtaaaatgaatttaatattatatagttttaattagaaatgagatgttttgttatattattagttttgttaatagaagttgagtgaatagatttatatttattaattagaaaaaagtataggtataaattaatatgttatttgatgtgagtagattgagaaagttaataaatttttagttatttaatttaaaggatattgaagtattataatgtatatatttaatttgattatataataatagttgttatttatttagtatttttttatttatatattttgtaatttttattattattttgtattagtttattttgatattgttataaagatattatttgagattgggtaatttatatggaaaggaggtttaattgatttatagttttgtatggttggggaggttttaggaaatttatgattatggtggaaggggtaggggaagtaagatatgttttatttggtagtaggagagagaaagagtataagggaaattgttatatttaaattattaatttttttgagaattttttattataagaatagtatggaaaaaatttttttatgatttaattgttttttattaggttttttttttaaaatatgtgggttataatttaagattagatttgggtggggatatagagttaaattatattattttgtatttgtttttttttaaattttatgtttttttatattttaaaattaattatgtttttataatagttttttaaagttttattatagtattaatttaaaagtttaagattaaagttttatttgagatatggtaagttttttttatgtatgagtttataaaattaaaagtaagttagttatttttaagatataatgagggaataggtattgggtaaatgtttttgttttaaatgggagaaattggttaaattaagggttataggttttatgaaatttgaaatttagttgggtagtttttaaatttaaaagttttaaaattttttttgattttatgttttatatttagggtatattgaagtaaggggtgggtttttatatttttgggtagttttgtttttgtggtttagtagggtatttttgtggtttttataggttggtattttgtggtttttttagatgtatattgtaaattgttggtgaatttatttttttggggtttggaggatagaggttttttttttatagttttattaggtagtgttttagtggggattttgtatgagggatttaattttatattttttttttgtattgttttagtagaggttttttatgaaggttttgtttttatggtagatttttgtttggatatttaggtgtttttatatatttttttaaatataggtataggtttttaaattttaatttttgttttttgtgtatttgtaggtttaatattatgtgaaagttgttaaagtttggggtttgtattttttgaagtaatggtgtgagttgtaatttggttttttatagttatagttggagttggagtattagggatgtagggtattatgttgtgaggttgtatagagtagtaaggttttgagtaggaaattattttttttttttagtttttaggtttgtgatgggaggggttgttttgaagatttttgttatgttttggagatattttttttattgttttggttattaatatttggttttttgttatttattatttattattttttatttattattatttattattttttgttatttatttagatttttgtagttggtttgaatttttttttagaaaatggggtttttttttttattatatggttaggttgtaaattttttaaatttttatgttttgttttatttttaaatttaagttttaattttagattatatttttgtgaatgtatatgattgaatgtttttagaattagttaagttattattaggatgttttgttgtttagaaatttttttttgttaaatattttaaattattttaaagtttattagttttttagggtaggggtaaaatgttgttagtttttttgttaaagtatagtaaaaataatttttgttttagtttttaataagttttttatttttgggattattttagtttggattttattgtttatgttattattagtattttggttaaaagtatttaaaataagtttttaggatgttttaaatttttttatattttttagtttttttttgagttttttaaattgttttaattattgtttgttatttagttttaaagttatttttgtatttttagattatttttatagtagtatttaattttgttagtattaattttttgtattagttagtttttatattattataaagaatatttgagattgggtaatttataagggaggtttaatttatttatagttttgtatagttggggaggttttaagaaatatataattatggtagaaggtaaagaggaagtaaggaaagttttatatggtggtaggagagagagaaagtataggggaaattgttatatttaaattattagatgttttgtgattttttatattattatgagaatagtatggaggaaattatttttatgatttaaatattttatattaggttttttttttaatatatggggattataatttaagataagatttgggtggggatatagagttaaattatattatattttgaaagtaggtatttttaattttatttgatagatgtagaaattaggatttagaaatgttagagaattggttttagaatattatattatatatttattaagaggtaaaatttaaatttgtatttaagattttaagtttattgttgttttatttttttgtatatgttaatagtaaaagtttggtttttaaattgtattatagattaagatagattaaattagaataatattataataattagaggatgttagaatttttttattttatagaaataaaggttaaatgatatttaaagtaataggtattataggtaagaaattaatatttttttttaaatattaatatttatgtattatttttttattttgtattttttagatatagataaaagggttgattatattttttttaaatatgtgaattgttttaaaatttaatatttttttatattttggtgagatttttttggtaaattatataattaaatattagttaaaatatattaaaaaatgtattgtggtgttgtatataatgtatatgtattttgatttttatatatttgtttatatatatatttgttaatttataataatagagtgatgtgttaagtaaattattgtgtagttttatttttgaaaatttaataatagaatataagttttgttttttatagtttaagtaagtataggttattgtggtttattttagaatatttattagaaaagtaatgtgttttttttaaaatgttatttgttaatattttagaaattgtatgttaaataaagaagaaatatttaaagtaagtgatgatgtaatttttgttttaaaattttagggatattttgtataatgtaaaaattttaagggtatatttagtattttttttgagaaagaataaatggtagttattgttgtagtgggagatgtgtaatgtggaagttttaaaattgataaatatttataagtaaaataatagtaaataatattttttttttttttaaaataattgttagatttataagtgaaattaatattgtatttttttaaatttgttttaaaagttttgttagagtttgtatttttataaaagtattgtaaaaattaattttaataaattaaattttttttgaaaagaattaaaaggaataagaatgtgaatgttagttataagaaagtatttttaaaattgtgtttttatataagtagttttgtatgtaggaaatagaaattgttgagtattattgtagattggatattgttgttaatagttttaaagtttaagagaagtggaatttttgaaaataaaagttattatttaaaattttaattattaatataatttttagagttgttatttttaataaaattatttttgaaaaaattttataagtaaaaatagttaaatataataataaagaattgtaggggatagaaagaattgatattgttaaaattgttatattgtttaaagtaattagtgggtttagtgttattgtttttaaaatattaatgatatttattatagaattagaaaaaaattattttaaaatttatatagaattaaaaaagggtataaatagttaaagtaattttaagttaaaagaataaagttggaggtattgtattatttgattttaaattattataaggttaaagtaattaaaatagtatggtattggtataaaatagatatatagattaatgtaatagaatagagtttagaaataagattatatatttaaaattatttaatttttaataaagttaataaaaataagtaatggggaaaggattttttatttaataaatggtgttgggatattattttatattagttagaatagttattattaaaaagttagaaaataatagattttggtgaggttgtagagaaagggaaatgtttatatatttttggtggaagtgtaaattaatttagttattgtggaaagtagtttgatgattttttaaagaatttaaaatagaattattatttgatttagtaattttattattgggtatatatttagaggaatataaatgattttattataaagatgtatgtatgtgtatgtttattgtagtattatttataatagtaaagatatagaattaatttaaaagtttattaatagaagattgtataaagaaaatgtggtatatatatattatggaattttatatagtgataaaaagaatgaaattatgttttttgtggtaatatggatggagttggtagttattattttaagtaaattaatataggaatagaaaattaaatattatatgttttttttagttataattaggaattaaatattgagtatatagggatataaagaagggaaggatagatattggggtttatttgagggtgggaagagaatgaagattaaaaatttatttattaagtattgtgtttattttttgggtgatgaaataatttgtatagtaaatttttgtggtataaaatttgtttatataataaatttgtatatgtatttttgaatttaaaataaaagtttaataaaaaagaattgtagggttttttggggagtgggtaggggagaaaaggaattaataaaataatgattatgataaaatttttatttatagtttaaaattagaatataaaatatttaattatttgttaaaatatgaattataaaattgatattttaaggataagttattaatttgtagtataaatagttgataattttagattaaatgtgttattgttgataaatgatttatatttttaatattgaaagttgataagtatttagaatattaaaataatatattataatatagattgttaaatattaggtggatagttagtgtatgagtttagttgtattaggattattttaagaaagtttgggtattttgagtgtttttttttttttttaatttataattttttgtaagaattatattgtggattataatatttgagttataaggattaagagtgtaattggggtttgttgggtgggggggtgggatagtattaggaaaaatagttaatgtatgttgggtttaatatttgatgagttgataggtatagtaaattattatggttatatgtttatttatgtaatttgtatattttgtatatgtattttggaatttaaaataaaaattataattaaaaaaagaattgagtagttgtattattagaaagatggtagtagtaagatagaagaaaggaaaagggtttaggtttaagtgattggaattatttttatatgatttttggtggtagaaatgtgataaggtgtgttttagatgattagaagtgaaattttatgttttggaattgttagataaatattttttggtttttgttgtatgtattgaaaggattgatggtgtgagtttatgggtgtagagaattattgtaagattttgtttaaagaaaatttttagtggtatttttgtaaaagttattttttagaatttaaaaatgttgtatatagtggaattttatgtgatttggggatttttaaatttgaagtttgtttgagaatttattttgaaatgtggataagttaaggttaagaataagattatttttttgatagataatatagtgattgaggagtatttggggaagtttggttttatttgtttggaagattttatttatgaaattgtttttttagggaagtatttttaggagattttatggtttttgtgttttttttattttttagtggtttattatgttattaaaaatagagtgggtttttttaaggagatgggtatatttggttattggggtgaatgtattaattagtttatttgttagttgaattagatttaggtgaggtagggttgaaaattgtttttgggttgatttttgataggttatgttttgttattttataagttttttttgtatttattagtatttaagagtaattttgagattgggaggaaagaggaggttggtataaatagatggagatttgttgggattagtgaatgtttgattaggatatggggttatgtatagtttaagagttataggtttaaagatgttgagtaattaaaaattgtattgttggttgggtgtggtggtttatgtttgtaattttagtattttgggaggttaaggtgggtagattatgaggttaggagattgagattattttggttaatatggtgaaattttgtttttattaaaaatataaaaatgagttgggtgtggtggtatgtgtttgtagttttagttatttgagaggttaaggtaggaaaattgtttgaatttaggaggtagagattgtagtgagttaagattgtgttagtgtattttagttgggtgatagagtgagattttattttaaaaaataaataaataaataaataaataaataaaaaattattgttgtagttatttagatggaaatggggaaagaataatattaataattgattttaaaaaggatttgaagatgtgaattatttattttgttgaagaaattttaattttttgaaattattttttattgttgttgttatatttttaggtgataaattgtggtaaattttttattagtgaagtggaagtatgtgttttgttgttttgggaatttttattaagtatttttagagaagattattttttgttttatttttaaaaattggaaaggaagggttaaagaaaagatagtagttggttggttgtggtggtttatgtttgtaattttaatattttgggaggttgaggtaggtagattatttgaggttgggagtttgagattagtttgattaatatggagaaatgttatttttattaaaaatataaaaattagttgggtatggtggtatgtgtttgtaattttagttatttaggaggttgaggtaggagaattgtttgaatttgggaggtggaagttgtagtgagttgagattatgttattgtattttagtttgggtaataagtgaaattttgttttaaaaaaaaagaaaagatagtagtttatgtttatgttaagtattttttattatagtttagttttaaggaaaaattttagtgttttttatattgggtgttgtgttatttgaaattggtatattttatggaggaaggagttttgttttgttgtatgtattttagggtttaatgttggtaaatgagttattttagtatttgtagaaggttttttgagatttttatagtagttgattaagtttaaggatataattgaatttggagagttttggggttttgttttgataaagatttgaaatatatataggaagaaaggtataaaaataaatgtttatttgtttttgttgtgaaaaaaaaaaaaaagaattaagagtatagagagtaatagaaagagggagattttttaaattatattggaagtagtaagtttttttagttagtttgaggaggaattttgtttttgtttttgttttttaaaagggagtaaaagggtataaatagtttataagaagtatttatttgaaagtttaattttttttatagtgtgaaaaagaataaaataatattagaaaaggttattatgatttttgaaatgtagtataaagttaaaatttgaaaagaagaagaaatattgaattagataagggtatgtaatagagaatatgaggggtttatatttttttgatattgtagggagtagttgaaatgattggttgatgttatttgtgggttttggtttgaataggaggtaatttgattttttttttattagtattaagaaattatattatatatagtatagtggtatatgttgaggtttttttagttgtaggttggttttattttttatttatgtgggaaaggaaaattgaataaatttaatatagttatgatttttatattgaggaaaattttttgtaattataaagtttaatttatgtttttatatttaatttgtagtttattttaagattattgttgtaaatttatttgttttaagattattgttgtaaatttatttagaattatatagttagatagaatgaaaaggtaatttgttaaatgaagttaaattggaagatatttttatattataaaaattataattatttagataatttagaaaatagtaaaaagtttaaattagaaaataaagttgttatttttttgatagaaaattagtaaatatttttatatatagtttgtattttttaaaaaaattgtatttatttattttggggataataatataaatggttaatttgtattttgttttttatgtgtggtattatttatttgtatattttatattttgataaaatttttatgttaatagatattttatatgattttttagtagttgtaaagtatttggttgtaatttttatttttttgttattggttattttttggttttttattattataaatattattgtatatatttttgtaaatgtttgattatttttttaagttaaatttttagaagggattggaaagttgatggataattttagggtttattatatggatttttaaattgtttttttttatttgttttaggaaaagtaggtaaaatatggatatatgtatttttttatatttgtttttaatagaaaataaatttggtgaattggttattgataaaatttgtttatttttttgttggggtgtttgtttttttttgattagtaagaatgttttggatgttaagtatttaaatatttagtttattgaggatatagttataaagtttttattttgaattaaaattttaaatattttaagtatgatgatataatttgtgatgtttagagttttggttgttgtttatatgataatttttttagttatatttttgtttgaagtgtatgtgagtttgaaaataaaatgattagttaaatgtagttttggttaaagatggtatatttaatatatgtttttattttagtttttttttaaatttagtatatgtttttaaaagtatatatttttaagaataaagagaagagataatattagtaatagtttataagatagaaagtagatggataaggattgttggttttttaagatttgttaagttattagtggggaaagttaagaagtaatttaattattatgaaaaaaaattttgaaaggtttaaaaattgggggtaaaggtaggggtttaaaattaggaagattggtttaaagtttgtttaagaatatttataggtttttttttatagaaatggtaggttagattatgagtgttaatttgtttgttaaaaattaaagtgttagataaaaaatatttttaaaaaatatttaggttaggtgtggtagtttatgtttgtaattttagtattttgggaggttaaagtaggtagattatttgatgtgaggagtttaagtgaggagtttaagtttagtttgttaatatggtgaaattttgtttttattaaatataaaaattagtgggtatggtggtatatttgtaattttagttatttgggttgttgagatagggaaaagtttgaatttaggaggtggaggttgtagtgagttaagattgtgttgttgtattttagtttgggtgatagagtgagattttgttttaaaaaatatatatatatatatatatatatatatatatatatatgtatatgtgtgtgtatatatatatatatatttttttaaaagtattattaagttgataaaatgataaagaattaggttaaatttaaaggaaagtattttaagttatttgtgtttagagaataatagatttaggtaaatttggattttaattaaaaggatagaaaattagaaaaatggataaaaaaatttatattttataatataggaattttaaatggttaataaatatatgaaaagttatttagtttaattagtaattagggaaatgtaaattaaaatgataataaaataatttatatatttattagattgataaaaattaaatatttgataataagatgtgttttgagtttaaggatgtaattattttggaagatagtttggtattatttagtaaagttaaagataagaatgttttatgatgtagtaattttattaatagatatgtatttaaaaagaaatttatatttgtaaataaattaatgtgtatatatagtaaaatgtgtaagaatgttggtagtagtatttttttggttaaataaaaattataaattagttaaatgtttataatagtggaatgatttataaatatttatatattttatttttgaggatataattttatatagtaatgaataaatgatagttgtatattataatatgaatgaattttataatgttgaatgaaaaaagtaagatgtaaaatgatatatataatattttatttatataaaatttatatatatatgatattttattaatatggaatttaaaatatataaattgagttatattgtttaaggatgtttatataggtagtaagaaaaataagaaaataatgattatatttgttagggtagtggttatttttggggaggaggaataaaataggatttgtaaatttatatggttatattggaggtttttaaggtattggtaatattttattttttgttttggttggtaattatatattgttagttttattattattattttttattaaattgtatgtatggttatgtatgatataaattttagttaatgatggatagtatttatagtgatggttttataaaattataatggagttgaaaaagttttattatttagttgtagttgtgtattgtaatataatattatgtttatgtttgtggtgatgttggtataaataaatttattgtgttattagttatagaaaagtatagtaaatataattgtgtatagtatataatatttgataatgataataaatgattatgttggtggtttatgtatttattgtattatattttttttattattttagagtgtattttttgtttttttttttttttgttaattgttaaatatttttagttaggttttttagtaggtatattagaaaaaggtattgttattatagaaaatgatagttttgtgtttgttattgtttttgaaggttttttagtgggataatatgtgaaggttgaatattgatgatattgattttgtataggtttaggttaatgtgtgtgtttgtgtattagtttttagtaatagttttaaaaataaaaatattttaaaaatggaaaaaagtttatagaagaaggatataaaattttttttatagttgtataatgtgtgtgttttaagttaagtgttattaaaaaggagttaaaatgttaaaaaaattaaaagtttataaagtaaaaaagttatagtaggttaaggttaatttattattgaagaaaatttttttataaatttagtgtagtttaagtttatagagtttatattatagtagattttatataataaatgttttaggtttttatatttatttattatttaatgatttatagtaatttttaattttggaagttttatttatagtaagtatttatataggtgtattatttttttttttttttatattgtatttttattgtattttttttatgtttagatatataaatatttattgatgtattagaggtgtttgtagtgtttagtatagtaatatgttgtaagtttgtggtttggaagtaatagttatattatatggtttaggtgtattgtaggatatattatttagatttgtgtaagtttattttatgatgtttgtataatgatgatattgtttaatgatgtattttttagaatttatttttgttgttaagtaatatatgattgtatatttgttttgtttatttttatgtatatatgtttgttttatagtaaaaaaaaatgtaatttaaaataaaaaatagaaaaagaaatagatagtatgattttttttattttagtttttgatgattttttattttttgttgtttatattttttttttttagaatttttaagttggttttttaatttttttatttttttttttattttatattgttgtttttttgtttttatttttgggatatttttttatttttattttttaattttttaattgagttttttatttatgttattatttttttaatttttaagagtttagttttattttttgaatgtttttttttttaaaattttttaatttgataaatgtattattttttttatttttgaggatataagtaataggtttgagggaagtttttttatttaagatgattgttttgttgtttgttttgatttttgttttgaagttagaagttttttttttttttttattttattttttttttttttttttttaggttgagggttggtggggttttggattaaaggattttagatatagttgagagtagaaatattttaaaaataaaaggaagtttaagtgagttattatatattaaattattaatggtatttatttagttgaagaatatagagaaaaagaagaatgaagaaaaattaatagaattttatggatttgagagatagtattaaatggttttatatatgaatggagttttagaaggggaagataatgaaaatttaagagaaagataatgaagatataatgattagaattagttaatttagtatggttataggatataatatttttaaaatattttatatatgtgataaataattggaaaataaaatttatattaatataatttaataattagtaaaatatatatatataatagatatgggataaaagatgtgtaagagttttataggaaaaatgagaaaatattgttgaaaggaattaaagatttgaaaatattgttgaaataaattaaatatttgattaaatggagagatatatagtgtttttggattggaagatttaatatagatttaatttttaaattgaagttttttatatttaaattgatttaattttaatgtaatattaattataattttagtaggttttttttgtgtgtgtatagaaattgataggttgattttaaaatttatagggaatataaaggatttggaagaattttagattttggttttgttttttggggaagggttagttatttttttaaagatgattttttttttttttttttttttttgagatagagttttgttttgttgtttaggttggagtttaatggtataattttggtttattgtaatttttgttttttgggttgaagagatttttttgttttagttttttgagtagttgggattataggtgtgtgttattatgtttagttattttttgtatttttagtagagatagggttttattatgttggttaggttggttttgaatttttgattttgtgatttgtttggtttggttttttaaagtgttggggttatagatatgggttattatatttggttaaaaggtgatattttttaaaatatattaattgatttattaaatatatatttttaaatttttaggtttggggatatatgtgagggtttgttaaataggtaaatatatgttatgggggtttgttgtatatattattttattatttagatattaggtttagtatttaatagttgtattttttttgtttttttttttttttttatttttagtattaggaattaaatatgaataatgaaggtagtttagttaataaaattgaattagttttttagtttgtgggtaaatataaaattttttttttagaggtttgataagttgttgtagttttgaaatgatttaaataataatttatatgatttgatttattaagaagtttgaaatatattaaataaattatagttttaaagaatgaataataggataatggaatgttaaaggaaaataaattaatttaaaggaaatttttatttgtaaaaggtttagtaggatttgttaatttagaattaggagtgttttttaatttatgaggtttttattttagtattttaaaaaattaatggtaaatggttttatggtttatagtaaaaggagatattttatttaagtaaagttattagaataatggtgattgtgagaagagttgaaaataaaagttagttatttagtaattagaatgttagaaagaaaaaagaaaagataaaaatagaaatatatttattattggtttttttaggatatttggatatatggtttataattattttaagtaatattttttttaaatataagaagagaagttttttaattgttaaaattgttttaatagaatatgtgtattatattttaattagtattagtatattttttgattattagaaagttgaaagtgaaatgatgttatttaatataaatttgtttttaaataatattttttttaagaatattttttagttattaaaatagaattttggggaaagaaaagatttattttaaatattttgtggttaaatataaaattataatttataatagataatatatttaaatgtttttaaattttattatgaattgaattgaaatattagtattatgggtttaatattaataattttatagtaaagaaaatatagagagggaggaggggtaaaatgaatgtttttttattatatgttttgatttatttttattggtgtttgtttaggatgatgtaattattgaattataagttgttttattgatgttatgtttaaaatgataagttttagttttttagatttttaataagaatttatgatagttatagttaaaatagtatgaataataaaaaggtgttatgtaggtgttttatagaaaaaaaaaaattaagaaattattatattttaagaattaaaatttttttttttttggttattttgtttagtttgtttattttttatgattatattataatgatggaggttaatttttgtttagtatgtggtaggtattatgttaaattatttataggaattattttggttattttaattttggtaatatttttgagaatgggttttattaatatttttatttaagggataaggaaattgaggtttagaaggtttattgtttaaggttattaaggtggtggttttgtgagaattggaatttagatttttagatttttaggggaggagtttatttaatgtattttgttgttgttttttatattgatgatatattaatgatatttattatggaaaaatatttgttgaattaatttaagagaagttggaaatgttagtaaaaatttttatagtagtatgagaatatgtttttaaaaattaggagaaggagatgttttaaaatgttttaagaaggaattagaaagttttgagtaaggaagtattgaaaaatgattgagtttttagttaggagttaggaaatgtgttttgtaattggaattataattgttttgagtaaaatagattgtgtttttatgaagttttaatagtttattgtaggagatatataaggaaaaggttagttaaaatatattgtgatttatgttgttatgtgagaatattaaaggatttttagatatagagaggtgttagagaagttttttgatttgttatgagttggaaaggtaagtagagagggaagttgaggaagagaagatagttatgtgtgaagttttttggtatttagagtatagtttttttaggggaatttaaagataatagaagatgataaaaaaatatattaaataatattagaaaatattgtttaattaaggttttaagtgatttgaaagttataggttaaattttataaggataaatataagatagtatttagggaatggaaagtgataagtataatggttatattgtttttttatatttagaatggtatagtattttagtgtaatgtagagtttagaattaggaaatgggtaattattgggattttagatatttttttattattaatttatagggtgataattaatagtttttttagtttttttgggttttggttttttttttggtaatttatggataaagttaattgtttagtaggaggtaggttgtttgatttgatagtttttttgggattttttaaaattaatgattttttaatttagatatatgatggttaataattagggatgaataataatattattttaatgagaattattaatagaaattaatattatgtgtgaggtaggtattattattatttttattatatagataaagaaaaatgtaaatttagagaagttaaattatttgtataattttatataattagttattagtggagttagagtttttttttaggtattttagttatagagtttatatttttaattattagaatatgttatatgtttttttttttttataagttgtaatatttttagtattgttattttgtgtgtatttatgatatgtaattttttaatttttataatatttttggaaggtgttatttttatttagagatgaaattaaaattttgagagtttttatagggatttagttgtggtattgggtttagattttattatgatttttattattatgtttttttaaatatagtaaattatagagattaaataaattagtattatagataaatgaattgtaaattttatttatttaattttttgttattaattaatttataaaaagaatattagtattaataaaagatattttatttttataaattagttattgttagttatttttttttttaaattgtagaattttattaattatgttttttttggattgtataagatgtagtatttttaagttatttaattatgatatagtgtttagaatttaaatatttttaaatattatattttgttatggtttatttggaaaatttaagttttaaaaagattaagataaattaggtaagagagaaaaagtagatttttaataattttttatatttatattgtataaaagtttgtttttttaatattataaagttaatttttaaattttattttagtatgttttgatagtatataggtgaaattaaataattattatattaaaataatagtaaagataataattaatattaattagttattatggtttaagtattttattaattttaatttttataaaaattttatgtattattattagttttattttatgaatgaggatatttaagtttagaaagggttgttaatttttttaaagaaagttatataattagaaaatagttatatggtaggtttttgaataatgttttgtttaatattgttttaatgttgatgagaaaaaaaaaatgatgttgattgggtgtggtagtttatgtttgtaattttattattttgggaggttaaggtgggtggattatttgaggttaggagttttagattagtttggttaatatggtgaaattttgtttttattaaaaatataaaaattagttaggtgtggtggtgggtgtttgtaattttagttatttgggaggttgaggtaggagaaatttttgaatttgggaggtggaggttgtagtgagttgagattatattattgtattgtaatttagtttgggtgatagagtgagattttatgttttatttttattttttataaaaaaaagaaaaaaaattgatgtttgtttagttttgtttagggttattgtttgtgtagagttggtttgttttttttatgtttgtgtagtttttttttagatattttgttttttttttatattttgaagttgtgtgtgatatggtaattggtatgtttgaagggttttagtttgagtgtgagtgtgtatttgagtgtattttataatggggtggtgttttgtttatagggttagttgttttgagttatgagtataagttgtaggttttttggattttgaattggaatgaatatattggaaaatgaatgaatataaattattattattgttttttgagatagagtttagttttgttattaggttggagtgtaggggtataattttggtttattgtaatttttattttttaggtttaagtaatttttttgttttagttttttaaatagttgggattataggtgtgtattattatatttggttaatttttgtatttttagtagagatggggattttttatgttggttaggttggtgttgaatttttgatttttagtgatttgtttgttttggttttttaaagtgttgggattatagatgtgagttattgtgtttggtttataaattaatataaaatgaaaatttataaagtttgtgataattatttaaatgtatgataataaatagtgtagtttaaaaatgtttagtaagtttgttttaattattatttttgagttatgtggtgatagggggtgttttttataatttttattttgtaaatatttattttttgattttatttattattattatgattattattatttattggtttattaaaaattgggtaaataattattttttgtttttattatttttaaatgtatatatatagtttatatttattttagtggttaatattataagtgttttgggtttttatttagaagtttagtgatgtttttgtgattagaaatatgttataggaatttaatttttgtttatattaattagtttgtggtaaaattggttttattagaggttgttttgtttaaggttatagtttttaagaatttattgatgatgttaagtgagagtttattgtatgtggattttaaataagtagattattttagatggtaggttttttattattatgttaaatatataatgttatgatttttataaatagtagattattatgaggtatatattgtatgttgttagatttttaaatttaggttattaaagtaagttattgataagttagagataattagtaagtaattgagatgatatttatttgtttaagtgagatatttgttgtggttaatttaggggttgtgttagggttattgtgtttttttttttttttttttgtaataggtttagaattttatggtatttgttatttaatatatagtataattttttaatttgttttagtttaggttttaggattttaaatttttagtttatatagagtggtttttagaagaggagatgtaatagaagaggaaaatagatttttatttagttttttaataaagttagtattagtttggtttgaatatagtttatgatttttttattttttattgatattttattttgataaaggtataggggttttgaaaatatataggaaattagatttttgtgttattgtaaaatttataaatttaataaattaaaattttttaaatttggttgatgttgtgattataaggagattgttattaaaataatgtttatattttagttgtgattaaaatgaaatatttttaaaatatgttaataaagtatagtagtaaaattgaaataattgtaaattttaaaaatttaatataattatattttaaatgtttttttatatattagttgttttaaaaattaaaaatgtagtatgttattgtttaatttaggatattttttttatgagtagaaaataagagaattataaaattaaataagatttttttataatttaagattgtttggtagaaatagtgaatggtataaggttaatgaaaattgatttttgatgttattaaagtagtaatatgtgtgtttagtgttttttgatttataatataggttttagtatatagtattgtaaaggaaatttttttttagagagggtgaagttttttttaatgagtatttttttttttgtttgttttttttttttagaatgtttatatagtataagaaatgtatatttgatatagaaaatgttaaatgtttaaatatttagaatttttttgtaattattgtagtttatttaaattgttttattaaattaaaaagtagagattaaattttaaaatttttttatttgttataaaagggaagaatatagtttgtaatatttttataagttgtagttattaatatttgtaagaattgaaattggtattttttttttttatgtgaaatatatatagatatatatatatatgaataaaaagaaaaatttgtatttgaaaatagattttaatttagtgttgttatttttaggttttaattttaatgttagttatttttttatagggtattatattagtaaagaattaaaggttttttttttttgtaaattttatttaaagtatatgttatttttaatgtttatttaaagggatagagagtgattttttgggaaatttattttattattatagaattggagattgttaagggttaatttaagtgttaatttttgttatataagaattttggtttgaaaaatttatttttttttttagtaaagattataaaattatatttttattgtagaaatttagattaaatattaagggataagtattatttgtgtgaaatgatattgatgtttttaggtaggtaatagttttattaaaatatatgttgttaaaatgtagtttttatgtaatttttaaaaattaatagttttgttttgtagaggataaagtttaaatttttttagttagtaaatatagttttttatattttgtgtttagtttgtttttttaaaatgggtttttatttttttaagtatatattttagtgttagtttttaatttttgttttttagtgaggttatttgagtttgtttatttggtgtttttttggtttgaggattatatttttaaaatataggtagtttgatagagtaaatttgtttatgattttttagtatttattttagttttttgggtttttaaggttttttgagtattttagtttatagttgtgatggtggattatttgttgattttgttttatagtattagtttgtgtttttggtagtatattttggagttttaattataaaatttgaaatgtgattttagataaaattattgaaaatgtttaatgaaattataaattataatatttagtgaatggggtaggttataaggtgttataatagtattttaaaaaattgatttaatgattagattaatatagttgattttaattatttgtagattttatatttgtaagtttatatatttgttatattttatttgtaatttttaaatttatatttgtttttttattgatttgtggataagtatagaatagtaaaaaatttgagttgattgatatgtatgtttttagttgaagttaaatgaagtgatatgttatttttttgttttagtttttaaattgtaaataagtgttttttttatggtaaatttagtggtatattttttgagttttgtgttttttgttgggaattttgttgtttaaaatggtttttatgtatagttttgaagtattatttagagtttttatgtatgagaagattatgatgtattttatgaagaaagtatatgtattataagttttgattagatatgatttatagtgttgttagttatgagtttaatgttaatgaattaataatatatattaagtatggtatttttaaatagaaatatatatgaaataagggtataatttaaaatttttttataaatatagaaagagaataggttttattgtatttgtaaatatttttttttataaatgttttttgtattattgataaaggaaaatatttgaataatttttttttttatgtatgttaatttggtgaaattttatataaatttttaattattgttgtattatatgtggtaaaattgaagtggagggaggattagagagagaagttttttttatagatttttttttttttagttttttaagtttttgagaaaggatgaggggggttaaagatgattttattgtttttttgtggtgattgttaaatagtggtagtatatttttttttagttgttttgttttattaaaatgtaggtttttttaaggatattattttttttataatattatttgatgatggttgttttttttttaattgtttttatttgagagatttaaggttaagaagggttagtatttttttttttattggataattgtttattttttttatgatgatttattattttatgtttgagatttatgagtggaataggtttatatttttattttttaattttttttattataatttatttttttagaagattttattttttttgttttggaatttggttttttttttttttaattttgttatgtattagtatttattgttattagatagtggattttatttatatttaggttttgggtttttgttttagttatagtggtttaaaatatagtattttttaaaataaattttttttttaggttttaatttgttgtttttttgtagtttttatagttttgttttttagttttgaaatttattttttttttgtttttttttttatttttttatatatttaataaatattttgagagtttattatatattaggtattggggtatattatagtgaaaaatataaatatgaatttttgtttttttaaaatttttagattagtaggagttgtagagatgagtatatagtagttgtaatataatgaggtaaatgttaggataggggatatatttggtgtggtgatggtattgaagagggatatttaatttaaatgtgggagattaagaatgggtttgtatgataatgtgatatttagttggattttggaggaagaggagaagtgaaaaggagatgaaggttagatgtgaggtgaagtatagggaatagtattatgtaaagatatagagttaagaaagagggaagtaaaggtagtttagaaaggttatataataaaaagtttattaaattataaaagattttgtaagttatggtaaatttttagattgtatttaggatagtgagaattttagggtgttttaaagaggggattaatttgattatatgtttatgtttgaaagttttagttgtagtatagaatatagattgaagatgataagggagttagttaagatgatgatgtagttatttagttataaaattatggtagtttggtttaaggtaggagtagttaagaatataagtagaagggtttgtgaggtatttatttagtttaatttatgaggtttaatgattgaaattatgtgtatagagaggggaaaagggtagttagggattatgtttagatttttgttttggggttgatagtattatatattttttgagatagggattataggagaaagaggaagtaggttttagaataagttaatgaattattttggatatgttgtgtttgagagatttataatttatttaagaaaagatatttagttagatagttggaaatatgggttaggaggtaaagagatatatttgagttggagatatagtagatatggttgttttttgtataaggataaatggtaattgaagtaatagaaaaggatgggattatttagagaaggagaaaatgagaagagggtttagtataaagttttgagaaattttgaaagaagaatttgttaagaggttagagaagtagaaggaggaaaattagaaatagaattgtgttatagaaattattggtagatgtttttataaataggattttggtgtttagtatagggttggtgttaatagtaggttattggaaagtgtttattgaatttaaggataagtaggttattgataattttggaaaggttaatgtgaatggagtggaagtagaaaattagtgattttgtaaggttaatgaattgttttatattttttaaatgatttttatatttatttttttatttttttttttattgttattattttagttaatgtttttattattttttgttagatttttagtaatgatttatataattgtttttgtatgtagtttttttttgagaattgtttttttaaataaaataaagtaatatatagtttattttatgtataattgttagagtaatatttttaaggtatagtttagaataagttaattttggtttaaaaatataatggttttttattgtttttagagtaaaatttaaattttttagtatgatgtttaaagttttttattatttggttttaatttaattgtttagttatattgtttatattttaaatatttatttttataaaaaaatgttgattttaaaaaaattaaagttatttaaagagttaggattatagatatatagataagaataattttttttttttgttgaggaaaaaaagatgtgtttagggttttttttatttatttattaaaatgaataaatagtatttgatagaatagaattgttataaaatatagataattgttttttttgtgttgtggtatgaaatatatggtttatagagaaaaaaaatggtgttttagtatttaataatatatttgattaatattaatttgttatagaaaatatttttattttattattagttaatttattttatatttttagttaagtaaaatgataaaaaatttataaagatataattttttttataaaggttttttttagtaattttgtagaagttatttgatggtttttaattgaaagatggtagtttttatatattttattaatttagtaagtgtgatagttttgtatttatattataagttagttgggaaataattatataggtaaaaagttattttaggtttttagattaattttaatttaaatagatgagagagatttataataaatttaagagaagatgttttaaagatgatttaataatagatgaagagagttttgttatataattttaggggtagtttaatttttttataatatttttagttatttaatttttttggggtggttttttaatattttatataattatatatatgtataaatatatatatgtatgtatatataatgtggtatgttgatgataaaatatgtttagtaaaaattttgtttttttataatttggtttgtttgttttggtattatattgtaatatggggtaagtggttgtaaagtgattttaggattgattataagaagattattgtgtattttataaattttatattttaaagaaataatagttattaaaagtatttttattgagattggtataatgagtttttatattatgaattgtaagaattggttattttagatatatttttttggtttatatttttttttaattataatttattatgttttttagttagagaaaaatatttttatttatattattgaatttttaatatattttatgttttttttatatgttgggttttttatttgtaaaataatattaatataggtatatttttgagatattttaggtttggttttagattataataaagtgaatattgtaataaagtaagttagatgaattttttggttttttattatatataaaagttatatttatattatattgtagtttattaagtgtgtaatagtattgtgtttttaaaaatgtatttattttaattttaaaatattgtttaaaaatgttaataattatttgaatttttagtgagttgtaatttttttttttgtggagggttttgttttagtgttgatgtttgttgattgattagagaggtggttgttgaaggtggggtggttgtggtaattttttaaagtagataataatgaagttttatttttttttttataaaagatttttttgtagtatgagatgttgtttgatagtattttatttatagtagaaatttttttaaaattggaatgaatttatttaaattatgttgttgttttattaattaagtttatgtaatattttaaattttttgttgttattttaataaggtttatagaatttttattaggagtagattttattttaagaaaaaaatttatttgtttatttgtttataagaagtaattttttatttatttatgtttttttatgagattgtagtaattttgttatatttttgggttttatttttaattttagtttttttgttgtttttattatatttgtagtgattttttaaattgaagtgttgaattttttaaatttatttataattgttggaattaattttttttaaattgttattaatgttgattttttgatttttttttgtgaattataaatttttaatagtatttagaatggttaattttttttagaaggtttttgatttattttgtttaggtttattagagtaattattgtttatagtagttatagttttataaaatgtattgatttgaaatttgaaattattttttgatttatgggttataaatggatgatgtgttggtaggtatgagaataatatttattttgttgtataattttattagagtttttgggtgagtttaggtgtattgttaatgaatagtaatattttgaaagtaattatttttttttgagtagttgaataggtttttatagtggttttaaaatatttagtgaagtatattataaatagatgtgttgttatttaggttttgttgttttatttttagagtataagtagagtagattaagtataagttttaagggtttttggatttttggagtggtaaatgagatttggttttaatttaaagttattaattatattagtttttaataagaatgttagtttgttttttgaagttagatattgatttttttttagttatgaaagttttagatggtatttttttttaataaaaggtttttttatttatatggaaaatttattatttagtaattttagttagattttttatataatttgttgtagtttttgtattagtatttgttgttttattttatatttttatgttatagtgttggtttttttttttaaattttattaattgatttttgttagtttttaattttttttttgtagtttttttattttttatagtttttatagaattgaagagagttaagttttggtttaaaggaatgttgtgaatggtttgattttttgtttagattattaaaattttttttgtattagtaagaaggttgttttattttttgattatttatatgtttgttggagtagtattagttattttttttaagagttttttttttgtatttataatttagttgtttagtataagagtttttgtttttggtttgttttggtttttgatgtgttttttttattaagtttagttatttttagttttttatttaaagtgagagatatgtaatttttttattttaatatttagaggttattgtagggttattaattagtttaattttaatattattgttttttagggatttgagagttttaggaagagggagatagatagggaatggttagttggaagagtagttagattatgtgtaatatttattaattaagtatggtgttttatataggtgaggtttatggtgtttgaaaataattaaaatagtaatattaggttggtatggtaattttagtattttgggaggttaaggtgagtggattatttgaggttaggagtttgagattagtttggttaatatggggaatttttatttttattaaaaatataaaaattagttaggtgtggtggtatatgtttgtaggtttggttattggggaggttgaggtaggaggattgtttgaatttgggaggtagaggttgttgtgagttaagattgaattattgtattttagtttgggtgatagagtaaaagtttgttttaaaaaaaaaaaaaaaaagaaaaaattaaagattattgattattggttgtaatagatataaaaatgatgaaaaagtttgatatattgagagaattattaaaatgtgatatagagatataaaatgagtataagttgttggaaaaatggtattgatagatttgtttaatatagggttgttataaatttttaatttgtaagtgaaataaaataaaataaatatgtaatatttgggaagtataataaaataaggtatgtttatatttaaatatgatagaatatttttataatggttatagttattatgttattaattgtttttagaagtaatattagaaatatttggagggttttattaaaatttagatatttaattttaaaattttaatttaggaaatttggtatatagttttggaatttgttaggtgatttttatttgatatttagttatttgggttgaggtgggaggatagtttgagtttaggagtttaagaatatagtgagttaggattatgttattgtgttttagtttgggtgatagagtaagattttgtttttaaaaaataataaataaataaataaatatatttaatgggggaaaaattttaaaatttttggtttttaaatattatataatattttttttttaaatagtgatggttagtaaattaaatatattgaaagtagggtagagaaatttttaaatgtgattttaaataaattaatataaggagtaagttaatttgagaaattttgtttaattataaaattattttttaaaaattttttattattatgttaaaggtatttagatttaatgaaatagtattaataatttttaggttatttttaaaagattttataagttttaaaagattttatgaaatatttaataattagtatagttgtgtttttaatgtttaaaagaggtagagataaataagttaaaaggtatttttttaattttgattgtgagttataagtttgatgttgtttgaagttaattggtatggtgtttatttatagtaagttgtttattttttgtttattaattatattatagagaaggaatgtttagagatatagagtgtttttttaagatagattaatagagaaagaggaatttataagtttattaaattgttatagatattgtttttaatattgttttaaaatattttaatttattttttataattttagtatttttaaattaaataattagtttttaatagataaatttatagtaatagtttattagtggaatgggtagtatttttttattagtttaaatattttttaaataaaatttttaaaggatataatattgattttaaaatggatttgaatttaagttaattagattgaagttgatttaaattgttttaaataattaatttttagtataaagattgagagtttaatattaatattaatattaagaaatggagtatttagagaaatagaaaatagaaaaaatgaattttgattattaagagaaaaatgggtgggaagtatttgtttagtatattaataattttatttaatttttaagtttaaatagtagagtaaattattttagtaataatatttaatattttttttggatttttagagttagtttggattgttttttttttttattgttttgtttttagtatattatgtttaataattttggagttttggtttttgtaattttttgattttatagtgatatttttgttgttgttttttttatttttttgttttttataatttgtattttttaaaaaaaaaaatatatgtaaatgttgttatattattaaattattaaattattttatatttttttataaatatatattttttgttgaaaaagtttagtgttaatgattattagatgtatgttatttttttttttaagagtttaaatgagaaagaatatatatatagaatattaggattagtttataggttagagtatatatgttatttttaagattttattaggtgtaagatttaagttagattttagttaataggtaaataaataaaattaaattttatttttgttttaatagttagtatttggaaaggtgttggatttatgattttggaaattgtatagtttataaatagaattttgaaataatgttgaggtagtagtggtatttttttatttttttagtgtttgtattttaaatttaaagggttaaaaaagtattaattgtaaataggttgaaagttatatatttataatgtattgttagtgtatttgttataggaaagtaagtttgttaatatggtaaatagtttgaaaaaagattatgtataaagaaaatttaaatttagattgatattttaataattatagggaaagttatattttttagataaatttttagtttttattttttttttaaattttaattaatgggaaaaagaagaataaaaaatattattttgttaatttaataaaattatatatggtatataaaattgagtatagtaatatgagaaagttgaaattggagaaaattaaaaaatatatgttttatttaataagtgaaaaataattttataaatatttaaaaagaattttgtaatttttagtgtgtagttgtattggtaaaaggtaatttaaatttattttatgaattataaataggggaatgttatgtttttttttttttgtttttttttagtttttatatttaaaaaattttttagagttatgtagatttttagattttatatttattttttttttttatgttgtgtaaggtagtatttttaaaatagaatttttaatatttaataaaaaagaaaattttgtgtaaatattttagttgtttttattgaaaaatatatatttttataattgtattgtaatttgtttattttaaggtggtatagttattagaagtttataggttattttgaaagtttttttttatttttttttattattttttatttttttttatatattttagatttttagaattaaaattagtttttttggttaataattaatgtaaaattttgagataataaaaaaatgtaagtatttgagtgaatgaataaatattaaatatttgattaagttaaatgatagtttttttatttgaaaatagaaaagttaagatgttttgattgttaagttattgtgtattattgaataggaagtttatgttttgtaaagtgggtaaggatttgggtagatttttttttttatttttttttgttagtagtattttttgtttattattttaataaattaaatatttattatatatagaattttttatttaagatgtttttttttaattatttagtgagatttatgttagtttagtagtggatataagaggatatgagaaaggaagaaaggttttgggataatttttatattaaaagtaagttttttataggagtaatgtatttaattttgaagagggatagttttataatgtttattttgattatgaattatgaatatgatagtattttttgaatatttttgttattataattatttaatatttggtattattaaatatttgtggagagaattatattgtgtaaatattagtaaagaattttaaatataagagttttttttttgtttttagttttaattagttttaatttatttttgttaaaataagagtttttaaatttttagtaaaatatttttttttaaaaaattaaattttggttgggtgtggtggtttatgtttgtaattttagtattttgggaggttgaggtaggtggattatttgaggttaggagtttgagattagtttgattaatatggagaaattttgtttttattaaaatttaaaattagttgggtatggtggtatatgtttgtaattttagttatttgggaggttgagttaggagaattatttaaatttgggaggtagaggttgtggtgagttgagattatattattgtattttagttttgtgaataagagtaaaattttattttaaaaaaaaaaaaaattaaattttatgtagaatttttaatatgtaagatagataaaagttgttattttattgttaaagttttttttgtatatttaaatttataatattaatttgtataggaagtaattagtaagattaatgaagatgttttgataaaattaatataattgaaatggaagttataaataatagttatgttagggttattattaaagtttggatttaaatagtttgaaagttattattttaaaattttattgtgtttttattaatagttttaagttttatttttaaatttttgtgaaattttttttttgtataaaaataaagtttaaattttaataaggtttattaaaatttagattgtaatatatgttttattagttttttgtaggaattattttttagttagtatggtttttttagtgttttttaatatattaagtttagttatttattttaataaatatatatttgagtgtttataatgagtttttagatttttgtttattttgtttattattgttttggatttttttttaattatttttaataaaagtttttttttattttttaaagtatttagtttttttgttatttatgaattttgaagtgtttgtttttataagttgtttaaatgataaatagttatatggtatagtgttaaggttgttaataaatgtattaaaatatataattttgtttttgatttggatttttaaaaattaagtttttagttggatgtggtggtttatatttgtaatttttagtattttggaaggttgagatagatagattatttgaggttaggagtttgagattagtttgtttaatatggagaaattttatttttattaaaaatataaaaattagttgggtatggtggtaggtatttgtaattttagttatttggtaggttgaggtaggagaattatttgaatttaggaggtagaggttgtagtgagttgagattatttttttgtattatagtttgggttatagaatgagattttgttttaaaaataaaataaataaataaataaaataaattaagtttttatttttattggaaggagaaaaaatttatttttgaattttaaaagtgaagatttgaaatttatgtattatttataggaaatgtatgtgtaaatgtgtatagtttaagtggtatttgtggtttgtttattttgttgagtattttaaaattttaaagttatagtttggtatatagaaaagttatttggttgttaaaaaaagttatattttatatatatatgattaaagaataattatttaaaatgttttttatagtatagtatttgattaaaagttttaaatatattaaatgtatgagttttattttattaatatttgtaaatttaataaaagtatttttagtggtttgtatataatttagttttaaattatgtttatatttttttgtgattttttgtgttattaagtttttttaaatttataaatgattgtttttttttagagaggatttgagatagttttaaaaaataggtaaaatttaagatggtaatttaaaagagagtgaaaagtttattaattatatttttataggagtagttaattggattattgttaaattatttagaaatataaaatatttaggatagtattagatttttatttttgtttgttgattaatttaagtttaatttaaaattttttattgttatattaagggaataattttaatatgataatagaagaatataggtttttaaatatttaattttgatgttataaatagtattaggttttgttttatttataatatttaataaagtattaaggatattgttttatttaatgatgtttttggggtttttggtattttattagggatttatttaatatgattgatatattaatagtaagtagagtgatttttaagttagatatatgtaaatatatagttaagttttaatgtaaattttttttgttataaattgatagttatattgtagggtattaggttttattttgagtttatttagtgaaaaatagaaataagtatataaaaattataatatattaaatataattttaaataaataagttattttatagaagaataggaatgagataaaatgatttattgtaggataattttgaattaagtatttttttgttaataattagagagtttattgggtatttagtttgaaaatagtttaaattgttttttttaatttaggtaatagtttttttttttgattgttagattaagttagtttatttagtataagtaggaagtatggttgaatgattaaagataaaataggtagtagtaatattggtattaattttattagattgaaattttggtttggattatagtataaattgaaaattgttaaattttaataaaattaaaaaaggaaataaaaaattaattgttagaagttttaattaatatttttaatattagtattagtgttttaatttttttattttttattgatttttttaaaataaaattaaaatgtaatataagtggtatttaaggtaattttttaaattttagaattttttttttaaaggaaagtttttttagaaataagatgtgtaatgtaagttgggtggatttttttatttgtatttaattttttgagttatttttataatttttgatagtttttttgagtagttaggaaaatattaataaataattgtttaaatattgttttatagataaagattgttttattattgaagttgttgtttggtggatagtattattaggtattgatttgaaatatttgttagttgttgtaagaaatttttagatgttttatgaataatagtttgatggagggggtattaatgtaatttttaaataattggaaatttgtatataaaaagtttatttgttttaaagttgaatttatgataattgaggattattagtatgttagataatgtataggaattattagattttaaagtttagataaatggtaaaatagtttgaaagatttttagtattgaattttggttaatatgaatttatttttaaaattaaaggggagtaatagtatttttaattattggttagttttgagagagataatatttgggttttataaaaagtgtttttaaaataatgttagtaaaattggtggaaaaaagaatttaagttttatatatttataaaagtaaataaaaagggtaaaaattgttaaattgaatttttttggaatttgaaaattaattaatggtttgaagtagtttagggaatttttattgaaaaataaaaataatttttttttttagtttatttttggtaagaatagtaaattttgtggtgttttatttagtttttatttattttttgatttttagtttagtagtagttatgaaaataatagtttatattttatatttttggtatgaaagatagtagaatggattttttttatgaagatttgtttttttttttttttgttgagatggagttttgttttgttatttaggttggagtgtagtagtgtgattttggtttatggtaagttttattttttgggtttattttatttttttgttttagttttttgagtagttgggattataggtgtttgttattatagttatttatttttttgtattttttagtagagatagggttttattgtgttagttaggatggttttaattttttgattttgtgatttatttgttttagttttttaaagtgttgggattataggtgtgagttattgtatttagttaaagatttgtaattaattatttggtttatttgtttggtgattttatggaagattattttaaaaggattgtttttattttgtttaatttagaattggtttagtgtttttttggggtatatgatgggtggaggagttgaaaatatttatgttaattttttaatttgttgttgtttgatagataattgttgaagaaaataatatattagtttaaagattgagaggaaaagttggggagtttgtaagggttttgaaagggtttaatatatttttggaaatttagagggttatatgtatgagtagggttgtgtatatgtttaggaaagatggagtaggttttaaatttttattatttgttgattttaatgttttgtagaagttggtagtaaaggttaaggtagggttgtaaattttttgggtaagagtttaaggtttgttttaatgtatatatagaggttatgggtaaagattggaagatattttgtttttaggtatttaatgaaatttttgttaattattaggtgattattaaattaataaatagagattttagggtgtttataatttttaaagaatataaaatttatagaattagttatgaaaagttattaaataaatatttataatatttattaataataaatattggggaggggagatagtttgattgttagagttgttatattataatatttaaaatgtttagttaataataataattataaggtatataaagaaatgaagtatataggaaaagaaagaaagaaaatagaaattatgtttgaggaagtttagatattagattttatagataaagatttaaaattattgtgtgaatttaggaggtggagtttgtagtgagttgagattgtgttattgtattttagtttgggtgatagagtgagattttatttttaaaaaaataaaaaaaaaaagatttaaaattagttattttaaatatatttagtgatataaattatgtttaaagaattaaaggaaagtataaaatagtattttattaaattgagaataatataaagatagtaatgataaaattgaattaaagagaaattttgaagtagaataattgaaatgaaaaattttttagaaaaaaatttattttatagatgttatttggagaagagaaaatttatgaatttgaagataggttaaattgagattatttagtttgaggaagtgaaagaaaaaagaatggggaggaaaaaattggatagagttttagagatttttgggatattattaaataaagtaatatataaataattagagtgatagaaggagtggaaaggggtaaaaagattatttaaaaaaaaaatagtggtaaaagaatttgatatatttgatgaaatatatttataaagtttaataaattttaagtagaatagattaataaagtatatatttaaatgtattataattaaattattaaaagttaaaggtaaagaatgaattttgaaagtagtatgataagtaagttattataaataagtgatttttaataagattaatagttgattttttattagaaattatggaggttagaagatagtatgatgatatatttataatgttgaaagaattatatgttaattaagaattttgtattttgttaatattattttttaaaaatgaaggataaattaatatatttttagataataaaaattgtgagagtttattattagtatatttttaatatatgttaaaaggagttttttaggttgaaataaaaggatatttataataattttattttgtttttagaaatataatattaggaaagggaattatataagtaaatatataagatagtaaaaatgtattttttgtttatatttttttttttttgtattggattttaaagataattattaagtaatatttttaaatttatattgataaatatatagtgtagaaagatgaaaatttatgataataatagtatagagtggaagtagaagaggtatatagaggtaaagtttttatatattgttgaagttgagttgatattaatttaaattagatttttttttttttttatttttttgggttagttttgttttggtatttaggttggagtgtagtggtgtgattaaagtttattgtagttttaattttttgggtttaagttatttttttaatttagttttttaagtatttgggattataggtatatattattatgtttggttaatttttgtatttttttgtagagatagtattttagtaagttgtttaggttggttttgaatttttggatttaagttatttttttgttttagttttttaaagtgttgggattataggtatgagttattgtgtttaatttaggttgttaaaatgataataaaatttttgtggtaattattaagaaaataattaaaaatatataataaaagaaatgataaagaaattaaaattgttatattagaaaatatgtaatataaaagaaagaaggtagtaatggaagaatttaagaataagagatataaaataaaggaaataaatggtaaaatattagaagtaattttttttattaataattatattaaatgttaatggtttaaattttttaaataaaaagtaaagattggtagatttaattgttatttatagagatttattttagatttaagaatataaatagaaagtaaaagaagaaaatattttatgtaaatagtaaataaaagaaagttgaagtggttatattaatatagataaatagatttaagataaaaattgtttttatagggtattgtataatgataaaagaattaatttattaagaagatataataattataaatttatttgtatttaataatagaattttaaaatatataaagtaaaaagtgatagaattgaagaaaataataaataatttagtaatattagttggagattttaatattttatttttaatagatagaataattagatagaaatttgtaaggaaatagatttgaatagaattatgtattaatatatttgttaaatattttatttaataaaagtagaatatatattttttttaagtgtatatgaaatattttttaggatagataatgtattaggttataagataagttaaataaattttaaaagatagaaattatataaagtatgtttttggattagaatggaatgatattgagaattaataaagaaggaaatttggaaagtttataggtatgtggaaattaataagtttttaaataataaatgggttagagggggaagaaattataatggaaattagaagattatattttgagataaatgaaaataaaaatataatatattaaattttaagggatgtagtgaaagtatatatatttttgagaaggaaatttatagtagtatatgattattttataaagaagtaagaatttaaattaggaatttaattatttattttaagagattagaaaaagaagaattaagtttaaagtaagtataaggaagaaaataataaagattagtgtagaaataagtgaaatagagaagagaaaaataatagagtaggttaataaaaataattaaagttgggttgggtatggtagtttatatttgtaattttagtattttgggaggttaaggtaggtagattatttgaggttaggagtttgagattagtttgtttaatatggtgaaattttgtttttattaaaaatataaaaaattagttaggtgtggtggtgggtgtttgtaattttagttatttggtaagttgaggtaggagaattttttgaatttgggaagtggaggttgtaatgagttgagattgtattattgtattttagattgggtgataagatggaaattttgttttaaaaaaaaaaaaaaagttgtttttttgaaaatggataaaattttattttagttagattgattaagaaaaaaaaggagagaagatttttaaattattagaatttgaaatgaaagagtgaatattatgattgattttatagtaaaaaaataagattataaaggaatattatgaataattatatattaattaattagataattatatgaaatgaataaattttttaattaattgttaaaaatgatttaaggagaaaaaaatttgaatggatttataataaataagtaaagatattaagttagtaattaaaaaatttttaaagaagattttagatggttttattagtgaattttattaaatgtttaaagaataattattaataatttttttttttaaagttttttttaaaatagagggaatatttagtaaattatatagtttattatatttattggttagttataatagattaatattttttataaatataaatgtaagtatttttaataaaatattggtaaattgaatttataagtatataaaaaggattataaattataattaagtgagatgaaatttaagaatatagggtttgtttgatatatgaaaattaattaatgtgataaattataaaagattagaaaaatatataaaaattttaatagttgtagaaaaagtatttgataaaatttaatgtttttttttgattaaaataattaaaaagaaaatatttaataaattaggaatagaaaggaatatttttaatttgataaaggataattatgaaaattttataataatatatttaaattgaaaggtttttttataagatgaagattaatataaagatgtttatttttattattgttatttaatattgtattggaggttttagttagggtaattaggtaagaaaaagaagtaaaaaatgtttagattgaaagggaagaagtaaaattatttttaattgtagatgatatgattttatatatagaaattttaaatttattaaatattttattatgttaattaatgattttagttaggttgtaggatataaaaattaatatataaaaattagttgtattattaattagtagtaatgaataattttaaagtgaaattaagaaaataaatttataaaagtattaaaatttaaaatatttaagaataaatttaattgaagtataagatttttatattgaaaattataaaatattaatgaaagaaattaaatatttatagaaatggaaagaagttttgtatttatgggttggaagatttattaattgttatgatggtaatattttttaaattgatttataggtttaatgtaatttttatttgaattttaattgttttttttttttttttagaaatggagagttgatttaaaatttatatgagtttgtaatgaatatggaatataggtaaagtaattttaaaaaagaataaagttggaagatttatattttttaattttaaaattttgtataaagatgtaataattaaaatagtgtggtattggtataagattagatatatagatttatagaattgtgagtttaggaataagtttatatatttatggttagttgattttaataaggtattaagattatttaatggggaaagaataatttttttaataaatggtgttgggataattaggtattattatataaaagaataagttagagttttattttatattatatatataaattaatttaaaatggattaaaggtttaaatgtaagagttaaaattataatttttagatgaaaatataggtgaaaattagtttgattttagattaggtaattttttaaagatatagtgttaaaaataaagaattaaaaaataaattggattttataaaaattaaaaatttgtgagttaaatgatattattaagaagtgaaaagatggttttttaaatgggagaaattgtttttaaattatatattttataagggtttagtgtttagaatatatttgtatatatatatatatatatattttagatatatatatatatatatatatatatatatatatattgataatttaataataaaaagataatttaattttaaaatgggtaaagaatgttaaagatatttttttaaagaaaatatataaatgtttaaaaagtagatgaaaagatgtttaatattgttagttatttgggagatataaataaaaaatataatgagatatttatatttaataggatggtgttttagtttgtgttttgttggtataattgaatatgtgagattgtgtaatttattaaaaaaaagaaatggattttttatatttttggaggttgggaagtttaaggttaaggggttatagttgatgaagaattttttgttgttggaggattttttgtagagttttaaggtgatatagggtagtaattatatagtgagaaggttgagtttattagattagttttttttttttttttataaagttattagttttaatttagtgataatttattagtatattaatttatgaatggattagtttatttatgagggtagatttttgatgatttaagtattttttaaaggttttatattttaatattgttatattggggattatgttttaatatgagttttggaggggataaatatttgaattatagtagttggttaataagaaaagatagttaataaatataggtaaggatagagaaattggaatttttatatattgttgatgggagtgtaaaatgatatagttattgtagaaaaatgtttggtagttttttaaaaggtaatatatagagttattatatgatttagtaattttatttttaggtatttatataagagaaataaagatatatgtttatatagaaatttgtatatgaatgtttttaatagtattatttataatagttaaagaatggatataatttaaaagattattagttaaggagtggatagataaaatatggtagtatatttatataatagaatattatttagttataaaaagaaaatgaagtgttgttatatgttataatatggatgaattttgaaaatatgttaagtgaaataagttaggtataagaagttatatatatatgattttatttatatgaaatgtttagaataggtaaatttatagagatagaaagtaatatttgtgattgttagggatgttgttaattattttgtaatatatagaatagttttgatagtaaagaattatttaattaaaaatgttaatagtttagaggttgagaaattgttttatggtgaagtttaatttattaaaaagtaaaaaagaattaattatgagaaaataaattaatattattttgttttaaatttattagagtattaagtttttatttattttgataatattagattaaaaggtgaaggagtatttagttattagttttaagtttaaagtgtattttggagtttatttattttaagatgtttttaaaattttgtaatttttaagttttttttttttaaatgaatttagttaagaatttatagaagagtagattaaattggaatttggttttttttagttttttagtttaagatattatgatattgaagtagtttagtggatttttataataatagtttttttaatttttttgtttatgttgttttgtaaagatggttttttgttatttatttaaaaataagatttttaagtagtttagaaatatattgagggatgttattaatgtattatgattgttttttttagttgattttatagtattttggaatagtagttaggaattaaggataagatggtattttttgtatatattttagatagaagtaatttattttttgtttatttaggatttgaaaaatgttaattttaaagaataatgtatattgttagtattttttttaaatttattaattataaatatgtttttattgtttagttaattttatttagaggggatatattaattttgtaaatgtattttttatagtagaataatttgtattttttaaattgtatatttatagaagagagttatgagatatgaagttaatatattaagggtattggttatagatttgtatattgtagaatattatattggtttttttagattttagtaaggttggtatttagttgaagttgtattggtttggttttagtttattattgtttttatttttatttaaatatttatttatttgagtagttttatgatagatgaagaaatataaaaatttttatttggaaatttttaatgatttaatattttaattaaatagtaattgaggaaaagaaagtttaaaggaagagaaattaggtttgtataaaagtaagatattaggaatttataagtggttggaagttttgtatttgagagtgatggtaatttgattttagagatttattaatttagtataaagttgttaaaatttgttttttaaatttttatggattatttagattatagttaagttaagtatttgtgtaaggtatggaggatattaataaaagtatagaaatatattaaatgttttttatgtgtttttttttgatatttaaataagtttttaattaattaaagattagaaaagggggaaattttgttttagattagattgtggtttttaaaaataaaatgtttgtttttgttattatatgtatattttttataatattaggtggttttttgaaggttattaaattagtaatattataattattaaaataaaatatgtttattttgaaaaaaatttataattttgaaaatttttttaattttaatatttttattttattttgaaaagattgtttttgtttttgatttatagttaaagtagatttttattatatagtttagtattttattataaattattttggtttttttatattttatattatttttttttgttgttttagtagattgtaaatttttggttttttttttttagtttttgttaagatgtaagagtgttgaaggtaggggattaatgtttgttgatagatattgtttatagtagaaattgtagttatggtgattaggaggtaaaaaagtataaagtaaaaaaattgtgggtttggtgagaagagttttggggttttattttatttttgttttttattagatgggtattattggttaatatgttttattttttttattttttatatttttattaataaagtagtggtagatgatattttttttttagagttattgttaaatgggattataaatgtgaatgttttgtaaatattaagagttttgtgtgattataatttattattatttatgttattattgttaaggtaaaatattaattatatttttttttttttttaaataattgtttatttatatttaaattgttgaattaattttttttaattttttttttatttttgttttttagtgtttatttaatattaaaagagtagtttttttttatatttaggagatttttaatggatgtttgaaattataggtagtattaaatattatatatatttattttaaatgtttttttttttttaattaagtatttattatatatattggttgtaaatttttgtagtttgagatatgatagtaaaattagtatgtattttttttttattttttataattttatgtataaaagatttatttttattatagattttagtagttttagtatatgattttttttttttatatataagtttagaatttttattttttatttaagggaagtaatttatagtttttttttgatatatttgaattgttaggattattatttttgtattttggggttattatgaagtaaaataaggattatttgaagttaagtgttgtaatattagaagagttaatttgataatttggatggttattaagtgattaaggggtaggtagtatttatagtatggagatgttgaataaaggaatgatttatattttaggtgggatgggtgggaagtataaaatttaaaattttttgattttttatttttgtaattttttatttaatatttttagaatatagttgattgtgggtaattgaaattttggaaagtaaaattgtagataaggtggattattgtataaattttgaaattttttgtaagggttttttgtgttttattatagttggttattatttggtttattaaatataagtttttaaattttgttgtaatttttaatataaaagttggggaggttaaaattgatttataataagtgttttttgtatagtataattgtttagaaattttttattgttattttgtttaataattataattattgttttgatttttaaattatatatgtataatttaatatatttattttatttagtattagaaaagttttagaatattaaaaaaagttttttttttaggaattttgtaattaatgtttattttaagttgtaattttaatgtttgtattaaaataaaataagtaaaaaataaaaataaaaataaaaaattgttttgatttttaaatattttttataaaaattattaaatggtattaagaaaaattaaatataaatattttatatttattatattgttataaatgtaaaagattagtattagtaaaagttgatgagaatatttttaatgttttttggaaataatttggtattatttagtagaagttgtagatgtgtatgttttgtgatttagttatttaatttttaggtataatttttttggggaaaaaaaaatttttataaatgtgttttaggagatatttttatagtagtgttgtttaaaatagtaaaattttggaaataatttaagtgtttattaataggggaatagagaaatgtatgtattgtatttattaaaaggtttaataaagatttttataaaaaagttttagtttatatggatgaattttataaataatgttgagttaaaaaaataagttataaagattatatttattggggggtggggggttaggggagggatagtattaggagaaatatttagtgtaaatgatgagttgatgggtgtagtaaattaatatggtgtatgtatatttatgtaataaatttgtatgttgtgtatatgtattttagaatttaaagtataatataaaaaaaaaagattatatttaatgtgattttataatataaagttaaaatatatgaaattaaataatgtattatttagggatatgtagataggtagtaaaattataaaataaagtaaaataatgtaaaaaatataaaatttattagtatagttttgtagatgggaagggagggggatgtgattgggaaagggtatttagtgagtattaaagggaatagtaatgagttgttttttaagttgggtggtaggtataaagaggtgtttattattttttatatatatatatttttttatgtgtatgaaataaaaaaaatttaaaaaatatgatgtttatggtatgatataaaaaatgtgttaagataagtttttaattttagttattttttttgttttttaataattgttttattttgttattttattgatatataaagtattatgttattatttttattgtttttttaggatgattattatttaatatttatattttttagattttaaattgttaaaaatttgttttagttttagattggtttggggaatgttttatagtggagtaaatgaaaataagggtttaaaaatatagtgagtaaagggttgggtgtggtggtttatgtttgtaattttagtattttgggaggttgaggtgggtggattatgaggttaggagattgggattattttggttaatatagtgaaattttgattttattaaaaatataaaaaattagttgggtgtggtggtaggttttgtagttttagttatatgggaggttgaggtaggagaatggtgtgaattagggaggtggagtttgtagtgagttaagattatgttattgtattttagtttgggtgatagagtgagattttgttttaaaaaaaaaaaaaatatagtgagtaaaaaagatatgattaggtgggtgattatttaaattttttagagagtttttagtaattttgatttttgggttttgttattatatttttaaatgggggtgagggtagggaggagagatagtatatagaaatttattttatgagtttaaatgataagggttttaaagtatagtgagttaaaaaaaatagtgagttaaaaagatattagatttaatattttattttgttaggttttaggttgatatatgtttagtagttgtatttgaatatagtttttataaaattttttggaggtttttattttttaaatgtttaggatatgtttttaagagaagtaatttgtatgtatatatatatgtatttatatgtattttatttgggtttttatattttattgattttttagagattttattttataatttgggatgattattatgaagtgatgaaaattataaattttattagtaaagggatgttggtatgtaggtagatattagatttaatatattattttgttagattttaggtagatattaggttagtagttatatttgaatatagtttttttaaaattttttttgggattttatttttttggttgagaaagtttagttatgttatttatttttaaatggaagtttttgggaattttatgtagaataaattattgaaagttatttatagagatgatataaaatttttaaaagaaaaatgtaaaaaaattatgatttaatgtttttgaaaatatttaagataattttaaaattttttttaagatttaaatttaaaaaaaaatttgaaatagttaaggggaaaatatatgtatatttgtataaagatatatatataaagatatatatatagatatatattgtaatattatagtagttataaaagagttaaaatttttttaataggggtttagttaaatatattatggtatatttatatggttattagaaagaatgaggtagatttgtttggatatggaaagatgtttgtgatatatttttaagagatataatttgtatgtatgtatattatatatatttatgttgtttatatttattttataaattagattgttattaaaaatttttaatataaattatgtatttttatttataagtaagttgtttatttttagaaagtataaaaaatatgaaaagtaattaaaagattagtaattatgttaatagtagagagttatttgataatttttgtaagaaatttatttttttgaagattgtttatattattggaaaaattgattaaagaggaatataagggttaatgtataaagtaatttttttaaaaattaggggaaaatttttattttaaaataattatgttatattttgaatagtatttggatgagtatttgggagaatataaaatataggatagggtttggtattttaaaaatttttatgaattatttttatttaaattaatatgttaataggtataatgttttatattatatttttatgaatttttaatgttatttagtttttaagggaggttttttgaaattagatttatgttaatgagaatttttttaaagtaaaataaggaaaatttttatttattagaaagttgaaagatgtggagaaaaaaaaaaagttggtatatattttgtataattataataagttaaaaaagtttgtattttatataagggtagtgggagaaatatattgatgagatgatataatggaaggagattggattatagttttttgttgttttataaatgtagttggaattaaagattgttatagtgggaaagaattgtggataaatttttatgtgaggatatagatatttaagtagggttaggatatttagagtatttttttattttttgtatatgattttttttatgatatttagtgtttttttttatttagagttatttttatatgtttatgttttttttttttaagtttatgatagattttaggagaaagttaggtaggtttgttgtttttggttttattataatgtaattagtatatggattatttggttattgtgggattttttttatgttattagggttttagtttgtataattatttttttggtaatagaatttattggtatatttgttgttttttttagtgtagtggttttaaatgtaggtgattatttaaaatttttagggatttttaaaaatttagatttttgggttttgattttgtaatttttaaatgggggtaagagtagggagggaagatgatgtatagaaatttgtattttttttattgtattttaggtgtagttgtgtattattagtttttaatattatttttgattgatttattatttgtgatttaagggtattagggtttggataaggtgtggtggaggattggagatttagaatgaatgatggaggagggaggaaaaataaggtagttattgttttatgggagagatagataggattggttttttgtgtatgtgaagtaggtgttgtgattttggttatattgggaaggtttttttgttttaaagtattttttattagttttttattaatgtttgaaattttatttttatgattttatttttttaagttatgttatttgttaaatagaaatattttttattttttagtattttattgtaatttttttttaatgaagtataaatttatttatttttttttaataatttattaaaataaagtaggtttaggagggtattgtattttttgatttggtagataggaaggggatgttatttttttttttttatataaaaaaaggttatgatttaatatgatggtttttgtaatttgttttaggttagttttagggtattatttatggagttgttgtatgttaggatgatatttgatttagaggagatgtgaatttgtataaggaagaattatttgatgatgttttgggttatatttttgtttatattagttttattattttttgattttttggtatattttttagtatttgttatagttaattgttttttaattattttatgtgtttgtattatgtttttttagttagatataggtttttttgaggttagaaaaaatatatgatttattttttttttttatgagtatgtagtgtagtgttgaaaaggtataaggtttttagtaagatttttattgatatattttattagtaggtaatatagggagaaatatttttatggttatttttttatgatttttttatttttgaatattgaatttgatttgttttttaagttttttttttttttaagtaattgttttttttaaattaagagtttttttttattagtttatttttgtaggttttgtaaaaatgtattgatatgaaattagtattaattatttgggaaaatatttttggattttaaatatgtttgagggagttgaagtttttgttgatttatggttgaaagtagtttttgtaaaggatgaaattgggggttaggtgtagtggtttatatttgtaattttagtattttggaaggttgagattagagtattaattgaggttaggaatgtgagattagtttgggtaatagagtattattttgtttttataaaagatttaaaaaattagttaaggatggtggtgtatatttatagtttaagttatttgggaggttgaggtgggaggattgtttgagtttaggagtttaaggttgtagtgatttaagtttgttttattgtattttagtttgggtaatagagtgagattttgttttttaaaaaaataaataatataaaatgaattgggaaatgttaattaaaatagtgaagattgtaatttataaaggttggtagtttaatttaaaaataaaaaaaattaagggtttttatgttaaatgtttttattttttatattaaattttatttttaataaaaaattatatttaaatgttattttttttttttttaagaaaagaagtttatatgaaaggtagttatggtgtggaaaaatttagatttgtttgtgtttataaatagataatgttagaggtggtggttttagtttttagttttttgagaatatttatttggtattttttttaaaagaggtattaattttagttaatatttttgattgtttgaattttgagatatttggttttttgtataaattaaattaatttagttttattgtgtgtgtgttttattttttttattattattagttggatgaatttaggtgtttagtttttatttaatatgataattatgtttaatataagaaatttatgtgattttatttttatatggtttttttaattttttaaaagtagttattttttaattgttaatgtggaatgatattgtttttttttttattttatgtaaaatttgatttataggagtgataattgttatatatagtattaaggtatttagtgtgtataggatggattataattttttaaaaaaaaaatttagattgggattgtgtttaatgttatattttttaatttatgaattatagggaattttattttaaggagatttttggatttgtattttttaattttgagttttaattattttttttttataggaaaatatttttagtgagtggttattttattggggttataattagttaaatatttttttttttttttttaatatattttttttttttttttaatttaaggaagatattgagttttatattttgaatggagtgtgggagttaggtttgtaataataaaagtagttatataagtgttttgtatttatttagttttttttttaaaatatataaagaatttgaggtttaggtgaattaattattattgaatgtttattaggaagattaatttttgtaggattgtagaaataagtgatggagttggaatttgaatttttgttagtttttaaattttaagattttatttttttgttataatgattttgtttttttattagaggtaaggtttatgaataatttggatattatagaaggattagaattttaaatatatttgatttttataattattgtgataaattgtaaaaaaataaaaataaaaaaatatttttttttatagttatatttttttgtagtgtaattgtagtttttttatttatttgaatttagattagttttgtgatttgttttgattaatagaatgtggtagaaatatagttgttttaagtttaggttttaaagagttttgtatggttttgttggtttttttgtaattttaatgttattgtgtgaaaaagttaagggtagtttatttttattatttattgttatagttaattagttaattgatagtagatatgttgaatgtgtttagttgagataagtttagtttggttagattagtagaattgtttattttatttgtagatttatgaagaataataaatggttgttattttaaagttattaaattttaaaagtagttagttttaaattgttaatatggaaggatattattttttttggaaagatattgtttttttttttattttatgtaatattttatttataggagtgataattgttaaatttaagtgggaaggtatttagtatgtttgttatagagtaaatattaatagatataataaatatagttattttgagtaagtagagaaaataaaagattgtttataaagtttataaaagagggttttgatatgtaaaagtttgatattaagataaatatttaataaatttttaattatttgatttaaatttgtaaagtaagattgaaaaataagatttgatttatttaagaatttgttaggtgttttggtgtaataaatttatttataaatattagtaattgtgtatttgaaaatttatattaagaaagtaaagttttttatattgtgggatttaatttatattgaattatataaaaattatttttttttaaagtttttatttgaagaggtagaattttagtattatgatgtttaaagtgttagtattttttttaagaagaagttaaagtaattggagaaaaaaagtaatgaagttatttttaaaattttaagaattttttaagatatgaaaggtttgtttttttttagatagttttattttaatttattttaattttaagttttttagaggtttaagtagttgatgagtgattgagagaggaatttgtgtggattatagggtaggggggtgggagaagagagttaaataggaagtatatgtattatatatgtattttttagtttttttttaagtttatggttgaaatataaatttgataatggtattataagttaaagtatttattttttaattataattaattagtttgaaagttatgttatttgtaataaattgatagttagtattatattgaatggggaaaaattgaaagttttttttttaagatttataataagataagagtgtttattgttatttaattggaagtattggaagatttatttagagtaattagataagagaaagatataaagggaatttaaaatggaatggaagaagttaaattatttttgtttgtagattgtatgattttattggaaaagtttaaagattttattaaaaaaatattagaatagataaatttagtatagttataggatataaaattaatatataaaaatttgtggtatttttagatgttaatagaggataatttaaaaaagaaattagaaagtaattttatttataatagttatagataaaataaaatatttaggaataaatttaatgaaagaagtgaaagagttttataatgaaaataataaaatattgaggaaaaatattgaagaggatatataaaaaaagaaagatagtttatgtttatggattggaagaattaatattgttaaaatgtttatattatttaaagtaatttatagatttaatgtaatttttattaataaatattaatgatattttttatagaaatagaaaaaaaaaattataggatttatatggaattataaaagttttggaatagttaaagttattttgaataaaaaaaataaaattggaggaattatattatttgattttaaattatgttataaaattataataatttaaataatatagttttagtataaaaatagatatatagatttagagaatttagaaataaatttatatatttatagtgaatttatttttagtaaaggtgttaagaatatatattagggaaaggatagtttttttaataaatggtgttgggaaaattggatatttataggtagaatgaaattagatttttattttttattatatataaaaattaaataaaaatggattaaagttttaaatttaagatttgaaattaggatattaaaagaaaatatttgggaagttttttaggatattggtatgggtaaagatttttttagtaatattttaaatgtataggtaattaatgtaaaaatggataaatgggattatattaagttaaaaaatttttgtatagtaatggaaataataaagaagtaatttataaaatggaagaaaatatttgtaagttatttatttgagaagggattaataattagaatatataaagagtttagataataggaaaaaattaaataatttaatttaaaaaatggataaaagatttgaatagatattttttaaaagatatataaatggttaataggtgtatgaagaaatgtttaatatttttaattattagagaaatgtaaattaaaattataatgagatattttattttagttaattatatattatttttataattgtatgtttgtattaaaatatgatttgtattttataaatatatatgtttattatatatttataaaaattaaaaataaattttaaaaataaaattgaaataaagttaagattataatgaagttagtttgagattaattaatgaaaaaggtttattttatgaatagtgtgtagtatggtataatagatagagtttttaagtaaaaatttttggtattaaggagttgtttaattttaaaatatattattaaaaataattttaggagtgttttttaagtgttagatattgtgttatgtagtttatatgtattattttgttgtgtttattttaaaagtgaggaaatagagtttatagggttatgaatttggttaagtttatatagttgttagttagatttatatttagggaatttgaagagttttaatttttatttataatattggatttagtttttttatatgaagtgagatttggatattaaaattagttttatttggaattttatgattttttgataatgatgggagtatatttttttgtggtttgtgtattgggtatagggatgaagattggtattttttattaaaaataaatgtttttggggtgtatgttgatatgaatttttatatttaattttttttttgtatatgtaaatatagaaatggtgaggttagtttgggaaataagtttattgtttatagttattttggttagtttattattttttaggtaaggtttgtttgtttttgggttttttttttaatttttggtagagtaggtattaagtaaatgttgaatgaatggaaaaatattttatagtttttgttggaaagagtttgaaattggatggtattttagaatgtgttttataaatgttttgaatgtaatatttataaattataagttttagaaaggtagaaataattaaagttttgtttattgttgtattttttgtagtttgaattgtgttttatatatagtaattgtttaataaaagtgttgtttttattattgttattagatttttatagttttagttttttttaagagaaagtaaaatatatgtattaaaggtaaggttatgttatttgttttttttgtggttttttgtttaaatagttttatttaaattgagtattttaagtgttaggtgttatagtgaaaatgttttttgtttttaaggagattggatttatttggagataaattagaaatatataaatagtattaatttaataaatatttattgggtatttattatgtgttaatgattaatttaggtagaaagaattgtgtggtttgtggttgttagaggatattattagatgaggtggggggttatggtttggattatataaaggaaagtatataaaataagtggtattaaattggttttgaatattatatatattgttaaaagtagagagaaggagtttgaattttagattgtaatagtttttagttatgttatatggtatattggtatgttgttattaatttaggatttatggtaaggaatttgttagtaataatgatttatgtatttttattataaagaaaagtataaatattgttagggggaattgtgatttgttataatttttgaaaaaagtaatttggaaatatttgttaaaattttaaatatatatatttttgatttaggaatttaattttggggaaatttattgtattattttgtttttatattgtaataaagaattatttgtgtttggataatttatgaagaatagagatttaattgatttatagttttataggttttaaaggaagtatgattgagaggttttaggaaatttagaattttggtggaagttgaaggagaagtaagtatatgtttatatggtagaggaggagatagagagagaagggggaagtgttatatatttttaaataattaggttttatgagaatttatgattatgagaataataagagggaagtttatttttgtgatttagttattttttattaggttttttttttgatatgtggggattataagtgattgagatttgggtggggatatatagttaagttatattattttgtttttggttttttttaaattttatgtttttatattttaaaatataattttgtatttttaatagtttttggaagttttaattttttttagtattaatttaaaagtttaagtataaagtttttttgggttaaggtaagtttattttgtttatgagattgtaaaattaaaaattagttatttttaagaaaaaattgggatataggtattgggtaaatttttttattttaaattagagaaattggttaagataaagaggttataggttttatgtatgtttaaaaatttgtaggatagttattaaattttaaaaatttaaaatgattttttttgattttatgttttatgtttaagttatgttgatataaggggtgagtttttaaggttttggatagttttgttttggtggttttgttgggtatagattttgtagttgtttttataggttagtattgagtgtttatagtttttttaggtatatggtgaaagttgttagtggatttattattttggagtttggaggatggtatttttttttttatggttttattaggtagtgttttagtggggtttttgtgtgggggttttaattttatgtattttttttgtattgttttagtagaggatttttatgagggttttgtttttgtagaatgtatggatatttaggtatttttatatattttgaaattaaggtagaggtttttaagttttaatttttgttttttgtatatttataggtttaatattatatgaaggttgttaaggtttgaggtttattttttttgaagtaatagtttaagattattttttggttttttttagttatagttggagttagagtagttgggatgtagggtattatgttttgaggttgtagagagtagtgtaattttgggtttggtttatgaaattattttttttttttagatttttaggtttgtgataggaagggttgttatgaaggtttttgatatgttttggaaatattttttttattttattggttattaatattaggttattttttatttatgtatatttttgtagtttatttgaattgttttttagaaaataggttttttttttttattataaggttaggttgtaaattttttaaatttttatgttttgttttttttttaaatttaagttttaattttagattatttttttgtgaatatatatgattgtatgttgttaggagtagttaggttatatattgaatgttttgttatttagaaattttttttgttatgaattttaaattattttttttaagtttaaagatttatagatttttagggtaggggtaaaatgttgttagtttatttgttaaagtaaagtaaaagtgaattttgttttagtttttaataagtgttttatttttatttgagattattttagtttggattttattgtttatataattattagtattttggttaaaattatttaatatgtttttaggaagttttaaatatttttttatttttttgtttttttttgagttttttaaattgttgtaatttttgtttattatttagttataaagttgtttttgtatttttatgtatttttatagtaatgttttattgttttggtattaagtttttgtattagtttatttttatagtgttataaagaattaattgagattgggtaatttataaagaaaagaggtttaattgatttatagttttataggtttaataggaagtattattgggaggttttaggaaatttatatttatagtggaaggtaaagaaattatgtttttatatggtagagtaggagagatagtgagtgaagagggaagtgttatatatttttaagtaattagattttatgagaatttattattatgagaatagtagaggagaagtttgtttttaggatttaattattttttattaggttttttttttgatatgtgaggattataatttaagatgagatttgggtggggatatagagttaaattatagtatttatatttagaaaaaaagttgttatttgtaaagggtatatagaaaagggtgtttattagaaatttgtttgtagtggtaaaaattatgaaattatatgaatagaatattgtttatttaaaagaatgggatttgtatttgttaatttggaaggatgtttagggtgtatttgttaggtgagaaaagtaagttgtagataaaggggtataagataattttatttttttatttaaaggtaagtaatttagaaaattttatatgtgtttgtttatgtttatgtaattatagagaaatgtggaggataaggggagatgtgtaggaagaaagaggaaagaaagaaataggaaaggagatgtgatggaaataagtttattaatattttggggtataattttattgatggaatgaatatattatttttgtaaattttgaaggggtatttgtaaaaagaagaataaattttaaaaggagttaattataagattatttttataatgtttatttatatttagatatgtttttttggataatagattgtgtataatttaaattttttaaaggttatggagagtttatgtggttatttattatttattattgtgtatatgggttgtggtataaagaaggagaattattatgttatgagtaataaaattatagatattttttgattaggggaataatattgaaagtggtgttttaggaagattaatttggtagtagattgtagaatgaattaagaagggagaggagaaaattagagaaataattaggagattattgataagagtaataagagtttgaattagggtgtggttagtttttttttgttgtgttggttttttagggaatagaaatttaatttttttttggtttttagtttttttattttatttttaattgaattttagggtttttgtggttttagaagtatgttttttattatttgttttaattatatttaaattttaaatttaagttttttttttaaaaaaattataaatgaaattattagttatattgtgttatttaagatttttttaatttatttggttttgatttttgggaatgtttttatgttttaaagattggttttaagaataataattatttatatatttatgttattttattttgttttttttatgttagttaatgtgataattattttttttttgttatattttaagattgttgttttttaattttttagttatttatttattttgtggttgttttttttggttgttttttagagttttgtttttgttttttttttttttttttttgaatattagagtagtttatttttaaatgattttatttgatttttttgttatggttaatatttatttaatttgtatttttttttttttgtgattgttattgttatattaggttgaatttttttataatttttagtagaagagatgaatttattttattaattttttgattgttatatattatagatagaataagttaaatttaaaatataaataagttgaagaaagatattttgaaaatttaggtaaaaataaaatatttttttttttttaaggtatttagtgattatatatatatttatttgaaaaatgaggaaattgattttttgtttgattttttaggtaagttagtataaatatatatattagatttatttgtttaaataattttaatttttataaaagtgaaaagtataaagtttttgttataaaagtttttatattgataatttattatgttattgttttgagtaagtttttaataaattattaaaggaaaaaattttttaattttttatttataaatattggttattttaattttttaatggtaaatagattagagttattttaagaaattatgaaaagtaatttattttgaagttttaaagtaaatttagagattgttaattgaaaatatattttttttatgtatattttttgtatttatatatatttgttagttttaaggtttatttttatttggggaagataatttgggttattattttttttttagtgatatttattatttgttgatattttttttatttgagaaagattagaaatataatttatttttatatatttttttggtttatatgttaaattttgtttatttaggtatttaatatgtatttgtagaggttttattatgtgttagatattattttagatgttggtatataggagtaagtaaggtagatagtattattgtttttatggagtttatattgtagtaggtgagtagataagatataaatagatgatgttaagaagaaggaaagattgtgaaagattttattattttagatagagtagttagagattttttttatagagttgatatttaaatgagagagtaaattatgtgggtatttggggaaagaatattttaggtaaattttttttagatttgggtttatatattggggagtttagaaagaggattattttttttagataataaggatatttttaagtgattagaagaaaaaaatattttgtaattagggtatataaattgaggttatggtgaaagttatgttttttttttgttttgtattatgtgatatttgatgataatatgtatgtatataatatttttatttattagttgttgaagttttttgttggtttatttttatgtatttagtttttatttagttaattaattttttttatttttttttttatttgttttagattttttgttgtttttttttttattttaaatagttgaattaaattttgttttttatttatttatgtatttttttttatgaagttttagttatgtttttttaggaaggagtttgagattttttaagtttatattttaaaaagtaaattgagggagggggaggtagggatgattattattagagtgttttttatgttgttggggatatttattttttttatttttatatgtttagtgtttagtttgataaatgtttgttgttgttaagtgtaattagaaggattttggagattatttagttaattttttattttatttattattagaatttttggtttagaatatgtttttgtagttttttagtttttttatttatgaatataataatgtagttaggttgtttattgattttttagtgtttatagagaaatattgaggtatataaaaattaaatttagttaggtattagaattgaagtttagaatttttatttttttttttaatagttttataatttttttttttggtttttttatttattgtttttttgtttaaatatgtttgtgggatttttaaagtattgtatagttttgttaaatattattattaattaaaaggttatttatttttaaaatattgaattagaaattattttattaatttgttttttttttaaaaatattttttgattaaaaatgtagtgtttatttatagattgtattaatattagtttatgatatgtgtttagtgatgagaagtatttgttatttaatagaaaatttattagttttttagttgatagaataaagtaagaggtttaaggtaaataaagtagtgtagagaaaatttgttagtagtaaaatattatttgttatgttaggatggttttttttttttattttttagttttgaaaatttataaattattttttggggagaaagaataaatatttaagaaaatagtttgtttttagtataattttaaaaaatttaaagtttttaagtaggttgttgttataaagaaattttaagaattttggtattaatagaatagttataaaatgaatattttatttttgatattattatatatgtttttattattttaaagattaggatttattttaatttagtattttttgaatagtaaatatgattaaatttagtaaatagtagtaataaaatttatttagtttttaaaagtattattagtaattgtagaggttttttttaggttgtgaggaataaaagttaaaaatatattaattttatattgtagttataatttaaattattttatgagtataaataattttagtatatttgagttgtttttgttatattgataattagatatttaattttttgatatattaagggaaatgtgtatgaatgagaaattaaattgtttgggagattgttgtaggaatttatattatgtttattttatatttgttattgttaaatttaagtttaagttaaaagtagatttattttatttaaatataaaataaatatttatttaaaaaattaggtttagaggtgaatagtttttattattttattattatgttaagaagagggaatatataaattgttattataaagttttttaataattttaagaaaatataaattagaatttaattattaagtattatttattttagaatagttattttgggaagttatttatttattttaggtatatttaaaatagaattaaatattttttgtagaaatatttatgtgggtttttttaaaaatttttaaagaaaataaatgttattatttgagagaggattaaatttttaaatatttggtaatatttatatgatttggagttatataaataaagttaagggataaatatattttttttgagtaagaatagttaggtgttattatagtgtaatgagtttgatttttttttatggtttataaggtggttttgaaggtagttttaaagaggagtaatatatatagttttttaaggtggaaatttagaatatttattttgggttttttgttttaaaaaaaaaatttaatttattttatagttatatattttgtttttaataaatttagttgaattttagatgataaattttatataatgttttgattaaaatttttttaagtttttatttaagaaagttgtttataaatttaggttttatattggtatgtttattaatttaaattgttgtttaataattttatgtttttttttgtttttataattttggtttaatagattaaatttgtttaattgaagttttttttaattatttgattaataaagaaaataagttagtgtagttaagttttataatttttttaattttatgtagttaggataaattttggtatttaatatatttaagagtttttttagatagttttaataaatgtaataaatgtaaaaaaattttaaatttgaaaattttatttttatttttaggtaaattaaggtttttaatgataaagaatttttgtatatttgattatataaaaatattagaataggaaatattagaaagagaatattttagtatttattaataaaaatataataatgtggttggagttattattatggttattatgtagatggtatatttaatattttttaataaaatttattgaaaattttgttgaaggtgtttttaaaaaataataaaattgaaaaaaaaaattattgtgaagatattatgttggtatttgaaggttttaaaatatagtagtttttatgaaattgtgatttatgattttttagggattgtatatagtagattttaaaagatttttgattataggtaatatttatattatagttatagatgttataatgtatttagttaatgagagttatgttggtttaagttaagtggatttggtagagttttaaaaattttattttgtatttttataatgttttttaatttttttttttttttttttttttttttttgagatggagatttgttttgttgtttaggttggagtgtagtggtgtaattttggtttattgtaagttttgttttttaggtttatattatttttttgttttaggtttttgagtagttgggattataggtattagttattatgtttggttaattttttgtatttttagtagagatagggttttattgtgttagttaggatggttttaattttttgattttatgatttgtttgttttggttttttaaagtgttgggattataggtgtgagttattgtgtttggtttaatgttttttaatttttaaagtaaatgtatatgtataaattttgttaggtaaaaatttttttattattttatagaaattgaaattgtgataaaaagtagtaagtgattttataaatatatgtaggagagtagaggtttgattttttatattttatttaaagatttgttgttgataaaaattattaaagatatatgaggaattaatatatttaatattaaatatttttttttagataagtgttaaggttttttggttttttttttttttttttttttaaatgtttttagtttttatatttgtaaaattaaggtaaataatagttgttttttgtgttttatggatattgatagaattgagatttaatatagtaattagaataaaaatttttatagagttgagatttaaatgagatgaatgtatgtaaagtgtttagtatagtgttgttatataattggtgtttaattattattaggtaaaaaaaaattaataaaatgaatagagaagaatatagatattgtatattttaaaaatttaaatgagttaaaagtaatttttataaaatatgtggttagtttgtattatgttaattaattatttgttttagatgtttagaagagatttagataattaaagaagtttattagggaatttagataattaagaattgagatatttaaattggtaatattgtttattaagtgttttgtgatttttattttaatattttttatggattttaattttttatttgaaaaaattagggggtagaattagggaaatttttaagtttttttaagttttaatttaaaataattgtaatgaatatagaaaataagttttgagaatttaagagttttattttttgggtgttaatagtagtaatagtttatttttatatattattaattatattattttaaatttttattttataaaaatattaaatttgtatttatatttatttgttttatatttgataatttataaagaaaatgttaaagaattaattttgttatattattttttattttaattattttttttattaaattgatgggttaaaaggattgtggaattttagaaatatatatataggtgttttgaaaataatttaaatatagttgtaaagaaagtatttttgattttaaagtatttagttggaggttatggattgttttttttagtattagaaattaggtttttggatttttagttgagtattttttttttgtttttattattgaatatttaaattaaattttttggaagggatggttaaaaaaataaaaaagtaaaatttgtaatttaaatagttttaaaattaaggaagtttttatttttaataattataaaagaaaatattaaaatgataatataaagtaaaatagtgtttataataaattggtagagttttagtgtttagtatgtgataattataaggttataagttatagtattgttttaattagtatgaaataataaattatgtagtgaattgtattattttataatagtttttaaaatttggttattaaatatatttttataatagttatagttaaatattatggatagttatgaaattaattagaataaaggttaattttattgtaaaaagaaatagtaagttaatattttttgtaataaattatgttttaaatattgtatatttattgaatttttaaattattagttataaaaataaaaatttaaggtaagataatgtgtaaatatttataattaattatattattaaaatttttttttttttatatatatttttggtgttttatagtgagaatgaaaaaaaaattataaaataataggtatttttattgaatttgttgtattatagataggattaatgttgttgaaatttgttaaaaagaaaaaatatttaaaagtatttgaaattaatatttgggttattttgaaaaagtatgtttaagtatgtagttttattgggatgtaattaatatttaaattggataagtgataaaatttggggataatatatttttatttaaaatattgaatttaaggaatgtattgtaatataaatggtttaagtgattgtttagtatttgtagaattttataatttattttgtatattatgaaaaattaatttttttaatattttagtagaaaaatatataatttatagaaatatattattaaagaaaagggttgttttttagttagttgataatggttgtaaaagggtattatgatatatgaaatgattatattaatattaagatattaggttgattatatttaagttattagatttttatttattaaatagtagtttaaataaaaatgagaaaaatatgaatttaattttagttaaaataatttttaagtaaaatgtgtattttatttttttttgataataaagtatagtaagaaataatataatttaaaaattagtattatatagttatggttagttttagatttttatttgaaataaaagaaattaaattgtaattttgattgatgtatttttttgtatttatagttttaaatttttttttttttaaatttttaatttatgatagttgatttaaattgttagtttttagaattgatttggatatttttaaatttatttatagtattttatatttttgttgtttttttttttttattttttatttttaattaatttatgaattttattggaaattttgtatttagagatatttataatagtattgagtattaaggaaagtaatttgttataattaggtgtttgggggttaaaattattgtttataaataattttgaattgtaataaaattttattttttttttaatatgtaaaatgaataaaaattattattataagttatattttaatttagtttagtatagaaatgattatatataatttaatagggaaaggaatatttagtagatttttttttttttaaaattgaaatttttaataggaatattttatttatttgaaaaatataaaatttaagtattaatagaatatgttagaagaaaataagagtagttggttttttgaagttgtagaaataaggatagtatgggtttttaaaaattttttttaaaggttaatatgtaatggatttttttttgtagttatagtttaatttaataaaatttttttgaaaattttttatgtaataggaattattaatgtatattttttatgatttagaaatatgaaaataagtgtttattaatttggtaaatatttgtaaatattgtattatataattatttttgatgaaaatattattaggatgtttttagaagggtaaatgttatttagtataaatttattttgtttatttaatttgtttatttaagtattagtatataatgagaatttattgtttattaaaattaggaataattattaaagtaaaaaagaatgtgttttaagaattaagtttaagttttagattttgtttaagtttaatgtaaattaagattttttgggttgttttagttatttgtaggttagagtagattaagatttatgtaattaattaattaatgtagatgttttgatttttatattaggtagttatattaaagtaaatttttttgatttaattttttttttattaaattttaaaaggtttttaaagtgatttttatttatatatttattttattattaatataatttgtatttaatttatatttatgtaaggtatattttagaataagttttttataaaatgtataaatattaaataagtagtaaaagtggttagattaaaatatatgtaatataaatagataagattaaaataatatatgaattatgttattaattataaaaatataaggggattagttatagaaatattgtaagtaattttaataaaatttgattatatgttagttatatatttttgtattagttattttatattaaaatgatatatttgaatatatagtgtgttttaaaaattttttttattaattatgtagttataataagttatagatttaaaaaataagatttttattataaagttaaaaataagtgaaaatatatttaaaaagaaattttttttaatatttagaaattattttatataaatgagtattagaaatattaagtttaaaaaatattgaaatatttattgttagaatttttagaaggaaaagaaaaagaaaaaaggtaggaagtaaagaaagtatttatgggggtgagggtaaattatagttaaaataaattttttttttttgtattttttttttttttgagaaaatatttaatatgatgttagtagaatttgttttatttattttgtatttgtataggtttttaattttattatttttataaaattagatatagatgtgattattaatgagatattaaaatttatataaattttagtagttttattaagtgttaattattatttaattttagattttgttgaaaattgaatttataagtttattttatattatttattttttttaataatttttttttttaggatatgaataattttttaatattaaaattttaatataattttaataaaagttttaatattatttaaaattatttttgttttttatttttgttattaatgtttaaatgaaataaggttgaaaattaaataatgtagaaatgtgtttttgttaataagtttatgttaaatgtattgaattttagtatttttaaaagtatattaagttagaatgattagtttgttttatttaaagaatagattttgagaataaggttttttttgttttattataaatgaatttagaaaatgttttattaagtttaattataatatttataattttataattttatgtgataatttaatgttgtggtggaaggaaggaattgtttttttttatttttagagaataaagtgaggatttttttttaagtattttgataaaaataattttaggtggtattttaaaaagttaaattgtaatttataattttttttaatttaaaaggaatttaagttattagtggtatttaatatttttttttgtaaagttagaaggttagtatttaagttgtggttttaatgtgttgattatttgttgattatttagggttattggttatagtaaatgtttggttatagttatgtaatatatagagaagagaaagtaattaattttagttatattagggttgttgtttggaaataatagattaatttaatgatggtttaaaagaaatattgttttaatttatttggatgaagttttgttttgggtaattatagtttttagtgttaagttaatgttataaggtataaaatttttaaatattaataaaatattttgtataaagtattatatttttttgttaggatatagattattgattatattttttaattatagattggtataaaaataataattttatttgatattaaagaatttttaaagagttgtattattattgttttgtttattatttttataaggttatgggatttaaattaaaaatatgtaaagatattttatgttatgaagtattataaaagttaaagtattaaaattatttttagtgatttaagagtaattatgtttatttatttatattttatattttagattttatagggtttaaaagtttatagtaaatggaaaataagttttgttttttgttttttttttatagtaaggaaaatgaaaattatgttatgatgattattagggtaaaatttattaataatttttaagagttttttaagatgttttatttttttttgtataattatatgttttataaattaatttaagagttttttatagatagtttagttaaattaattgtatttaatttttttaagaaaattaagtatgtgaattttattgttaaaaatttgtaattgaaaattttaaaatatagtatgttttttagtatttaaaatataatagtttatgtaataataaagattttaaatttttttattgaaaagattttaaatttttaatttaggttgaagtagtgtttttttaaataaaggataattatttaaataatagattaggaggtagtttatattaagatatgtaagaattaaggttttttggtttttttttttttttttttgataattaagttttttagaagaatagaatatagtttaaatttaattttaaattatttttttaataagaaaagttttttaagtatagaggaaagaaaagagatattttttaggttaggatagtttttatagaaaaaggatttttaaaaatttgaataattagttaatgggaatgatgaatattattaatatttaagaaaaaattttaatagttatatataaataaattattgtttattatgtttttttttaaaaaaatttgttgattaattaattttgtgttattataatttatatttttatatttttttttataattaaaatggatataaaatttagtatttatttgaattggggatgaggttatggggtagagaaatttatttttattaatatgtatatttatatttagaatttttttttgataattttattttttgatttttttgggttagataaaaatattagtatgtttataaatgattgagtaaaaaaaagagaaaaattaaatgaaagttgaaaattgaagtttaataattttggttattagttatttatttgagaatttgtaggaatatttgaatgtaaaattttgttttgtattatgttgatattaattttttttttaaagagattgattagtagatataatttgtttattttatggtaagaattttgtgagtaagatttgtgtttaatattatggtttggtatattgtttattgtattgttttagtaattttaaaatttaaattttttaatagaagatttagtttgaagaatagggttttttgttagtatttttgtttttaattttttaattttaagttaatatttaatgaatttataaataaggtagtataatttttgattatgtaagtaagggtattatttattgtaatataagaatatattttaaaatagttgaatgattatgtataatataatatgatattatgagatattatatttttttgaatttatataattttttgttaagatatttgttaatgagtaatattattttaaaaatgttaaataaaatttttattgttggttaatgggatattgaaaattattatttaaggaaaaaatttgaaatggttatgtatagatgttatttaggttgtttattttttttatttttaaaaggttatttaaatttatttatataaaaaagtatatgaatttttagagaatatatataaattaatgaagatttatatttattaatttattttaaatgtattatttttaagaaatagaaaaatattgattttattttgaatagttattagaaaaaattgtttgattagggaagtttagagtttttagagaagttaagttgttatttttagatttttggtatttattttaatttttggaattaatgggaattggtggaatgatattaaaaataggtttttgattttgttgttgagaaagggatgttgtatttatgttatagtggtatatttgttttttagaggtatttatattatgaatagaaatggtagatattttattattaattatatttgttttaggaaagtttgtttgatagtaaattgtgtttagttttttttgtttaattattttaggggtgtagagtttgatgaaattttttttttttgtttttatttggggtagtgttatattattggggtttgataaaattagatttttattatttttaattttgggtttagtgtttggtaaaatgagaggtttgtagtttttatttgagtttttttttaaaaggaatgaattgtttttttttgttagaggagaaagtaaatagtttttatttattaataggtttgatttttaaggatttttatttgtttttttatttggggatttagaagaaaattttaaattttgtaaaatgttaaaggtgttttggtttgtggtatataattttatattgttattgttggtgttagtttggttttttaaatgttgttgttttgaagatatattagagtgagtttttggaaattttttttttgtgggggtagtagatatagtagtggatgttgaatttttggggttttttggaatattggttgatttattgaggtttgtaatgtttttttttaaaagttttaagtttgttttttttgaggaaaggttgatttggttttgttgtgggaattttaggttattttttattatttttgtttttgttttttttatatatagttttattgagagtgaaattgttttggatagatttggttgttgtgtattgtttattgagttttttggaaaattaattaaaagtttttgttgtttggagtttgattgagaagtgatagttagtgagggtgaagatgtagaaatttttatagtagtttttttttttagggttttatagaagtttattatatttttttttttttgagtaagtatattgttggggtttttttttttattaggagttaatgattttttggagtttattagtgaatattaattataaaataaaaaataaaaatggggggaaaatattataagttttaaagttatattatttttttgatttgattagtaagaggtagtttgttaaatgaattttttagttaattttgaattaaattttttgttattagaagagtagtttttattttttagaataaaaagttatgttttttgtttttatttagtatgttatatttaaaagtataatgtaatttatttgtatagttgagggtaaaagtgtattgaattaagtttggttatttattttgttgtttattgaatgtgtagttttgttaattatagatattataatttattatatttgattattttgaaggtttaagttgatgttaaagtatttaattttaaaaaaaggaagtgtgattattaaaatttttatttttttttaattatggttgtttgtttttttgagaattaatatatataatatttgataaatattatgttagaatttttaatttttaattatttttaaattttttttttattagttagttatatatttaaatttttgagtataattaattggtgaattatgtatgttttttttgaaaaataaataatgttgatttgtttattttttgataggttgggaaaaggttttttaatttatatttttgattggatgtgtttatttttaaattttggatatatgaaatgagatatattttatataggttaattaaaatttagattttaaagagtagaagagaaggtgtagtagttttttattatgttgttagtttatataatttaaatatagttgatttttattataatttataaaaatatttagattaagttatatttgtttatattgtttgagatttttaatatgaaatgttattatatttttaagtttttttttttttaaataaatattgaagtattgaaaaatggaaaaatatagaattgtaaaattatatttatataaatttaggtataattgtatttagtaaaatgtttaaaataattttttttgtttttatttatttaaatttttatttattttaatttttagtttatttttaagagagtaagattgttagtatattgttaattagggtgttttaagagatgggttaagatggagaagtgtatttgggatattatagttaaattttgtttaataaaaggtaattttttttatgtgatgatgttaggtagtataaatgttattggtttttattgaaaagtgaatatgaaggtagagagaggggtgtggatttgttattataaattttgagggtaaattgtttatttttttatttttttgttttgtttatttgaggtgataatgatttttaaatatgaggtattgaatggagtttaatgaatttttatgttgtttttttgatagttgtttttaaatttgaaattaaaataatattttttaaaatgaaaatgtttttttaagtgatattattttttagtttaagttgtaaataatttagttatattaattggttttaatgaattatgttagagggttttaagtggtattataaggttgtaattattaagtttgtaattttaaatgttaaattagtatttgtaaaaattgtagtataaaattattatggttatagggggtttttttttaaaaggggttatttagaaattttaggtgtgaattaataataaatgttaaagagtaagtttttgtggggtgggggtggagaagagaaaaaagtgtgaggttaaaagagaagtatgtttagatttgttgagttttttttttgatatgtttatttttaatagataatgttggttttggttgtagtttttaagttgtgggttgttagttttttgtgtgtgtatttttatgtgttttgtatgttttttttaagttaggtgttgttggggtttttttggagtttgggtttgtgtttgggtgtgttggggtggtgtgtaaatatttgggtgagtaaaatttagatgtggtttagtgtttattatgaaaatgggtgttgggtgatttttttggagggaaaggggatattagggggagaaaagaggttaggatttttgtgaggaatgagaggtttgaagtttttggtagtttgatagggttttgtttgttgtttgaggttaggttttttttttttggtttggttaggggatgtttgtggagggagaggaagaggttagtgttgttatttgtgtgttgtttttttgttattgttgtttggtttttgttagttttttatttttattttttgaggttaataaaagtttgtaggtttttgtggtggtttttgagttgtttttggttttagtggtattttgggggagtgagtgtgttttggtttttttttgttttgttttttatttttggtagaggagttgtttgtttgttattgtttgtagtttttgttgtagttgagataaataatttagtttgtgaatgtagaaggagtaggagggaaatatattttttttttttaaaaaaaggaagtaaatagttgtttttttttttatgggtggggggagagtttttatttaagaaagttttttattgtttagttgataagttagttttttgttttgtgttgggttttgtgggttgaggttttgggtgtgtgtgttttgttttggttttagttgttttggttgttttggttgtggtgtttttttttatttatagaatttgtttttgatgggtaggtggtgatttgggtttttgttatagatatgagtttgtaaaatggaggaggtggtggtggagggaagagagtgtggatatgtgaaagggtagtttggtttgggtgagtgagtgggattgagtggggagtgggtggaggtggtgttatggtgtgtatatatttgtatatatgtgtttttattttatttttggttgttttttgtttgaggggttgtgtggtggttgtggggaatgatgtaatttgttggtgatgtttggtaattgtaggggtgtttgtggtttttgtttttatgttttttgtgtgggttttgttattttggttttgatggtgtttgtatgtttgtgttttttggtgtggttgttttgtttggtgtgttgtgttttgttttttgtttttaattttttaggaaaaagggtggtggtggtagtggtgggggttgatttggtttttttggggtggtgttaagagggttattgagtttttttagtttttttttttgttattttttttttgtttttgtttagttttgtggttttagatttatttgggagtttgttttgttttttggtggtaagtgttgttagtgtttttgtgggtgatagtgggtgggttataagagttggggtgttttttgtggttgagttgtgtgagtggtttgtgttgttgttgttgggttgagttgtgtgaagtgtgttattttgaaaggggttatggggttgtatggaaatggtgttgtagtgttttggttgtgtttggggttgggtggtttgatatgttttttggggaggttttagggaagggatgggatagtgggggttggtgtatatgtattttgggtttggggggagttgtgtgttggtaggttttttattattgtattatttgggtggttgggtttttagttgttgttgttgtgtttttgtattgggagagaagttgtaaagtagaatttatttttttttgtgttttgattgttttttatttttttttttgagtttgtgaggtggtggtggtggtagaaggaggtgttgtttgttaagtttaatttttattttttttgtttaatgtgtttatatttgaaggaagttgtatgttaaatgtaaaatttttagtgagttggatttttttgtattttttttttattattatgattaaggaaagtagggggtggtaggtttaaaagtaagttgtaggtgaaatagtaagttgttggtgaaatatagttttttttttgaaatttttgatttttttttttattttggttagggtttgtgtttaagtttttggtgtaggttttatttttgaattttgatatttgttgtttttgattttgtgtgttgtttattttattatgtttataggatttttgtttttataaataaaataaaatataggtagttttaaaatgttagtgtttaattttttatagatgtttttgttaggagttttttttttagtttaaggggaagggaatttgtggtttgttttgagaaaggagagggttgtggggtgaggggtgtttgtgtgggaagtttttgttttagtttttttttttagtttgttgtgttgggaaggtttggatgatgttgggattgagttttttattttgtgtggtatagattatgatttttgtgattttgggaaaggttgtgttgtgtgggtttagggtttggggaggtaatttttgtgtttttataggtgatattgtttgttagtttttgatatgggtgggggttgttgtagttttatttaattttgtttgggtgtttggttatagttatttttttattttttgttgtgtttagattgatggtggttttttttgttttgatattttgaagatgattggggaagtgtgttttggaagttgtttgttgttattttggtagggtatagtgttgttagtttgtttttgtggttattattttggtaaaggtttgtgattgtgggtagtttaagttgtttttttttggtttttaagggtaaatggttttttgtgtattgtttgatgtgaaaggaaagaagtaggtttttagtaagttttttgtttggagatgatttatgggggttgtttttagaggattttggagttgttattttggtaaaggaagagatatttgttattttggaaaagaagagggaattaattgtatgttaatgtagaatttttagttagaagaatttttatgaagggtgttgagtaattttatgttaataaaatttttttttggatttagaaggtagattttgttttttttgttttttggtataagttaattagaaggaggtttttgttttggatgtttatttgtgaggttatgagaatattgtttgatttagttgtttgtttttttaatttttgagttttaagtattagaatgagatgttttttgttaatttggtttttaaattattaatagttttatgggaaataaattaagatttaattttataataatgttttatatgttttaaaagtgagttaaatagtttatgttaataattatttttgtatattgtttaaaatgattaagaattttatttatatatatatgtatgtatatatatgtatatatatatatattatatatatatatatgtatataattaaggggataatatagttgtttaatagaatatatttttttatgttattagtttgttttattgttgaatttttgttttaagaatttattttattgtttatatatgtttaaatttttagtggtaggtattttgtttaaataatttatgattttataagagtttttaattattttttttttatttttttttttttgtagattttaatggggaagaatatgtagttttaaatatgttattgaaaatgtttttaattgagtaaaaaaaaaaaaaaatttattttaatttttttttttagtaatttaaatgtgtttgttaattttttaatttgatagtaaaaaaatttttattttttagttttttatatttatttggaagtatgtatgaattataagttaattttttttttttagagtaatataaatagttatgatttgtggttaatatttattgatttttatttttttgttgtttatttttgttgataataattaaatgagataggtattgttatttgattttttaatatgaggataataggtttatagaggttgatgtttgtttaagtttatatggtttttatgtattaagagaggaattagataatattaaagtggttttttttattgattttaattattaatatgaagtagtatattaattttgatagattatttataatatgtgtttatggaatttaattgaagagatgaattttagtgtgttagaaaggatgtgagatttagtattataataataatataattttaatgaaagttaatatttattgtgtatttgttgtttgatagatattattgaaagtgttttatgtatagtattttaagtttttaggtatggtatttattaatttgtaattttgggaatttataattattataagaaataggatgaatttttatttgagtgggaaggtatttgattgttttagaagtagaggtggaaatgaaggtgatgtatttagatttagttaaggtaaggatttgatttattttgttatagttttatgttttatttttggaatatagtttattatatagtaggtatttaataaatatattatagggttataataatattgagttaattagttaattagatgtaaaattatttttattgggttattgttgtggttaaatgggttaataaaaagtgtatagataatttttaagatttttatttttattgttttgtgtttaaatatttgagtgttttttttatttttttttaaaataaattagattagatttttgattgtatgtttttatagtattttgtatattttgttagtatattataatgatagtttattatttgtgtttttatttgttatttttttgtattatttattagaatataagttttgtaaaggtagggattgtgtttgtttgtttatttttgtattattagtgtatagttggtgtttagtgggtgttggttaaatgaatgaatgaagataatatatggttttagagattatgttttaaggttaataaaattttaagtttgattaataattaaattatttgatatattgattttagaaattgatatattatttaagtgagtttttttattttttttatgttttgttatttttatttttattaaaataatttaagttgtattgttagattatttttttaaaatattaattaaattaggttgtgtttttttttaagtatatataataatttttgattttagtgttatatagattttaatttttagtatggtatttaagattattatttttatttatttttttgtagaaagtgaagttttttagtggatgtgattgaattggagtttaatttaaaaattagttaaaagaaggaaataattttaagaaagataatttgtaaattttaaatttttgaaatttttgaaatttaaaatttgtgattgaatatttattttttaattttttgatgaaggtttaaagtttttatgagtttattgattggagttttatgttttttttagtgtgtgtataaattatatttgtaatgtattgatatagtgtagtagttaaaagttagattataaaggttaaatatagtttttattattaaaaggaatgtaattttgggtaggttaattttttgtgtttttttttattatttgtaaaatggggataataatagtattgatttataaagattaaattagtttgatatatgtgaagtgtttagatgaatttttgggttataggaagtatttgtttattattagtaattattatttatttgtagaattattatttttttttttttttttaaataaagtagaataagaaattaaagatatatatttagtatttatgatttgaaatgtttaatattgaaagtgttttagattttggatttttttttttttgattttggaatatttgtattataatgagatattttggttatgggatttaagtttaaataggaaatttattttttgttttatatatattttatagtttgaagataattttatataatatttaaaataatttggggtatgaagtaaagtttgtggtaagtatttttatgtaggattttttatttgtggtattataataatgtttaaaaagttttggattttggagtattttaaaatttagatttttaagttagggatgtttaatgtgtatttttagaataatttttgtgtagatttttaaatttttatgattttttatttttgtttttatattagttttttaaaattgttttatatttattttatttgatgtaattgtaagttaaggaaggttatagggtatttttttatttagattttatagaataattttttatatttattttattattttatttaatatttaattaaattaagtaagtatagtaataagtaataaatggtataaatatgtttgggaagtaaaagtattaggaattgttggtagtttaattggtgggagtagaattgtgtgaagtgtagaagtgattatggttttagtgtttagtgtattttgggtattaatttattgttttttagggagattggagaattggattagttgagattgatattgagtagtgtttgttatatgattttgttaaagaaaggatataagatattatatttatttttatgttttttgttgtttattatatatatttttttttatataagtatatttttttgtgatttatttttttatagtttgtgattttttgttatggttttagtttttatttattttttttttttgtatttttttattttaaatgtgtgatgttaaatataaatgggaattatgtatatgtgtattgtgtatatgtgtattgtgtattttgaatatgttaagtttatataaatagtttttattggtggttagaatttattttaaaaaattatttttgtagttattatagttattatttgtttttttaaaataatattttgattttggaaaatatttttatttttatttaattttataaggtaagaggtttaagggaatttagttgagttttgaatgagttatttttgtttgttttaatatttgtattttatgttagatatgtttattataaataatttatattagtatagtaagtttttaattataatgaattttattttggtattttttgttgtaattagaattaatatttttgtttggattgggaaatgttaaattattattagtttttttgttgttttgttgttttttatgatgtttttaatgattttattataagtaatttaaaatattataatttgtgtttatatgtgtgaaatgtttaatgggtgttttggttgattttattttttatgttggtagaatttagtttaagtaatatttgatttaaggatgaggtagttattagtagataaatgagataaatgttgttataagtaggaatttaatgtttttaatgtttggaggtattagagtaagtatattgaataattgtaataagtattatgtattttgtttttttatttgtggtatttgtggttttttatatgttattagtttttttttttttttgatttaattttttttttttttttatgtttttttggtaaagagtgttttaatttgttttgttgttatgtggaattttttagtttatttgagaatttgtatttttattttggtttttatatttttttattagagtatatagggttttgttttgtttttaagttaatttagaaatagtggggttgagatgaaaatatttttggtatagggattttttaataagataagaagatattttatattaaattttaaagtgttataaaggatatttgttattattgaaaaaaaaattgttttgagattagtatttgttaattaaattttttttatttttttgttgaatttttaatataagatttggtttttagattttattttgttatttatttatttgaatgagtttggggtaggtatttgattttttttagttttgttttttaatttgtaaaggaaggataatgatatttattttatttattatataggaagtaatgtaggttttatatgggattatgtgtttaaatgtttttaaatattaagttttatttggaaaatttagaggagtttatggaatttttgtattattattttattataataaaaatgaaaattattattgtttttttttatttattttttagggaattagtgtaatgggtagtttggaattttaggtaggggagtgataatttagtagtgtattggaaataattgtattagtttgtaagtattgattgttaaatttttagagattttgtaagttggttgttaattatagttattattaaaaattaaattatttataaatttataattaaatattttaataataaaaataaatgttgaagattttattgtttaattattttattttattttattattatttatgtttttaaagttatttttgtttgttttgtataagaatatattatatgatggtatgatgtagtgtatttttttttaatgttgtatttagaaatgttattttggtagtttgaaattaattatggtggagtatttatattatagaaattgggaaatatgataaattagagtttgatttgttttgttgattgtttagattgatagagtagaagaaattttaataatgaagattgaatttaaaagtgttttagtttgtgaatataaaaatttgaggaaatatttttttagtatttgaaagttattattagtaaaagaagttatttttgttattaatgaatgagtttagttttaatatttatttttgttgttttatttttattttgtttattaatgtaaaaatattaattaatatttatgttgggattttagtattatgaatgatttttttgttgattggatattaattagatatttatttgtggtttgattttgttaaatgtgtttgaattttagttgtaggttggttatggatataaatattttgtaaaaattattgaaatggttttgtgaaaattatatggttatatagaatttattattaagagtgttatatttttttttgttttttgtaaattatgtgatatatatatgtaaaaattataaaatatatagatattttgttttttttaggagttgttaaatatttattaatatattaatggatataatttaatttattatttgaaaagtttgttttgtttgtgatgtggagtatgagttgtaggggttaagggagaaagtagggagagtagtgaggagataggtatattggtttaaggaaagatgatgaagtttgtattggttgtaatggtaggggagttggggagttatggttggataggagaggtattttgaaggttaaaggtaagtaaagtagttatttagtagttttatgaaagagatggatttttaggaattttttatgttaagagaagattttttggtgaagagtaagtaggtttagttgaatggggtgagtgtatagaaagttgtgttagagaaaaggagttagggagggttgtagtaggaagtaggagatgttggtagttttaggattttaaggtaaatatttttatattagatggagaaagttaggttggattgttagttaaatgttgaattgttttaaagtgtagggggggaggggggaggggaagttttaaatattagtaatatgttgtaattggaatttatatattaagttatttatttagtaattttattgatttttgtttatatggaggggttatttgtttatttttatgttttgagtttattttaatttatagtagattttttttttttatatttggtaattttaattataaaatttttatattgaattattttgtgttatatatatattgttgtttttttttatgttttttatttttttatttttatttttttttgttatgttataaagaaggattttattaaaagttattttattgttttgtttattagttattagaaaatttttggtaattatagttttttttattttttttgttttttttattataatttataatttatattttatattataggtttttttgtttgggttttaatattttttaagagaagttattatattttatggagtttaaaaaatagtaaatgttttgtaaaagaaagaattatgtttttatatttatttatttttttaattttaatgattagaagaaggaaagatttttagttatatagttattaatgattaatattttgaggatttagtttggatatgttgtttattttggttttttgatgattagttattttaggtatggttttaattaattagggaatgtttattaatagaagagatttttttaattaatattttttttatttatttttttaataaaagagaatttttttaataaaatataatttttttaataaaatagtaattattatatgttaggttttagtataaggttgtagggatattaaaatgataataattttttttttggaggaaatggagatagatatggttataagttattatagaataatgtagatttatagaaatgtgttagatgtatagggtattttataagttttaagaagttatttggtgtttaaggttaggaaaatgggtgtggatatggagatggtggttatggagggttttttagaggttagtaggattgatttgaattatgaagggttttttttaagttatttgtttttttttttttttgaagataatatttttaatggaagtttgtagataatatttattaggttattttttggtgtatttataagaaattttattgttaaaaatagagttttttgatttattgaaaagtttaggggaagtttaattttaggaggtatgattggatttaggggtttaaatgaagtttaaagggtttaaattttattttttagttttatttttttgttttgttttgttttgttttttggaaagattatttttatttttttatttggtggtttgtggtatttggatttaatatattttgttaggttagtaattttagtggaaagagttttttttttataattttagtagttgtttttgggaggggttttattggtttagttggtttaaatgtttatttttggattaataattatgattaagggatgttaggaatgtgtattatgatgggtaaagtttagtttaagtgtttattattgatatttaagaatggggtataaatgaaagagagagaagaggaggtgtttttttaaataattggagattttaaatttaaataggagaaaagggatttttgggtatgtagaaaaaaatttagatgtttatgataatagttttttattaaaatattaatagtgatataaatattatattttatattttaagagaatagatatgatttaaaatgtttgttagtaatggaaagaattttgaaaattaagtatagttgttataagttttattggttttattttttgtttttaatagaatgtgggtttgtattttgaaattttaaatgttatataaatgaattgatgattgttttgtagaaatagtatttttatttaattgggttttttttgggtgatgaagtgatgtttataatttttaagttagttttattgttttttattgaaggagtttgttttatttgaatatgattttaataatatgatgggtataggtggttgtagtgagtttttgtttgtttattttgttttttttgttttgataagttgaatgttatgtaaatgttttaagtttttgtattgggtaggtaggaagttagaattagtaatagaagtagtaggtattttgtgaatatttgttgattaattttagttttataggtttgatgggttttttatttttataattattattagtaaatagttattgaatgatgtttagtatatttttatttttttttttttgattttgatttttattttttattttatttttttgtgattttattatgtgtgtttttgtttattagattaatagagttttttgtgattagtttataattatttagttttatttttatttatgagatatttttatttgtttgtttaaatttgtttttgttatgatttagtttaagttttttttggaattagggaaaggatgaagtgtgaaaaaaaaggaattaaatagtttggttattgaatggttattttgtgtttgatgttatattagtatatttttatatttgttttataagttagttttttttattagaagtaatgtttaataagtttataagtattgattgggtttattttatagagaaaatggagagtagtgaagggtgaggaggttatgagttatggatatgataaatggggaaagattttatagaagagagattggggttatttaagaaaaattgttatttttgtgtagatggtattagaaggatgaaaaataattttagatattatttatgtttttaagaaaaaaattttaaaagatgttagaaaataatatatatttattgtaaaaatttaaatatatagaaggtagaaatgtataaaggtaaaaatttttttatataattttattttgtagatgtaattatttttttttttttatattttgatggtaataaatttgtaattatttttgagtttttatgtatattttagattttttattttattatttttttttttaaaaatttttattatgtgaaatagaaagtagaattgtgattattagaggttgggaagggtagggggaaggggaggatggggagagattagttaatgattataaaattatagttagataagaggaatgagttttgatgttttgtagtattataaggtaaatgtgattaattataatttattgtatatttttaaattttttttgtttatatatggatgtatgtatgtatatatgttttttaaaaataaaaatgagattttattatatgtattttttaatttttatttattaaatgttattggatatttttttatttttttaatatttttaggtaatagtagtatagtatattattgttttaatttttttttattgaagtatatgtaaattgtttttaattttttattattgtaagttatgttgtaatgaatatttttgtatttagatttttttgttattgtataattattatagaattgaaattttttaggtaaatgtgatttgtaataattattaagtatttaaaagtgttatattattgggtttattttaaaaatgtttgtttattatagtttattttttatttttatttttttttagatattttagaaaaaattaattagagtagtagttatggatggttatgtaggataggttattagttggagattttttatgttttgttattgatatagttttgttgaatttatttttatgttaaatgtattaataatttaagaggattggtttatatatgaattgggaagggattatttagggatattataatgtttgatggttgtttttattttattagggattttgatttgttttgttgtggttatatggtagataggtattgttttatttgttaagtattttttttttatatatgatattaggatttaatattttttttggaaaattattttttttttaattttggtttatgtgtttatggtggtattaatttatttgtaattttgtatgggttaggtttggtaatattagagataggtatatgatagggatagatatattttaatttttggttttttgggattatttggaaatttgttttgttttttaataggaatagttaagttgatatgatgtaagtttggagtagttgtggtttattatttagagattttattggattgaggtttgtaaaaaaaaaaagtaaagagatttggaaatagatttttaattatataatatgaatgtttagattttaaggtgagggttgtttttagatttgattattatatattttaatatattattttttttttttttttttttttttttttttttttagttagttggagttagttaatatttgtattagaaagggttttgatattagaagtaaaggtttaaaatatgggggtgttgttttttttggaagagatagggaggttaaggttattagatatggaggatgattttaaaagaaaaggggagtttaaaagagaagttagttgaatgtttaaaaataaattttatttgttttataagtttggtttgagtttttttttaatgattaattagatgagatggttaaattttttttttatttaaaatatataaatataaataagaatattagtttttagttaatttatttattttggttatatttgttttaggtttttattttttttattaatatataaattgtttttttattttaggttgtgtttaaaaagagagagagagagaaatttggtaattttttaagaaatgttttatgtagtttttttttagggtttaaattattattttattttttatattgatttagttttttgttttattgttttgtttatagtagatttggtaatatattaatagtatttataaatatgatttagtggaattatgtattaaaatattttaatatttttttagtatttgtgattttgaaattgaaatttgatagttgaagaaaaagttttattaagatgaaaaattaattttttagtggaattaaatttataatgtttatataaaatattgtttttgttttatttatataaattttatattttttttttttattagtggtaggggaatatggagtgggatgttattagttggatttaatagatatttatttatttattaggagtttgaaatagatttgagattttattttttagtagatatatgtttttagtaagttatttaatttttttgaatgttagtttttttatttgaaaagtaaggttaataatattatttgttttaggaggtttttatatagattaaaaaagatattttttgtaaagtatttagtatggtttttgatatttaattaatgtatggtaaagtaatttattattatgtttttagaaagtgagatagttttgtaggtatattttaagtagaaagtatatgtttatatataatatattaattttttttaaatgaagttttttttttttttatattatggattgtgaagggagtatttgtttaataaaagaaagattttgtaaaagaaatttaggtattggttggaaatttttattatatgatttattaggttttttttagttttgaggttttataattttataaattatataagtttatatattattgtgggatttgatttttatgaaatttaagagaattataggttttttatatttagttgagtatgtttaaataaagatagatatttaaaagtatagatattgattatgtgttttttaattagtaaaatattatagttaaaagaaatagaagtatagagaaataaaatgatttgtttgaagttttattgatttgttaagaaattagattgaatgtgtaagtttttttaatttttagttgggttttttatatattaaatatagtgatatataatttttagttgttaatatttattttttatgagtttattgtttgttatgtgttaatttataaagttatttatttatttatattagtgttattaaaaattttttaattttataattatagtttgtgtaatgtagtagataaagtattgggttgggataagggattgggttttggttttggttttgtttttttttttttttgtttttaattgtatgatttgggtaagttatttttttttttttggattgtttgtttttttttgtttaagtatttggatttttttttttttttttttttaatttatatagaagtaattatgttttttttattatttttaattgtaaagtttttattagatagtttatatttattggttatttgttgaatgtttttgtgtagtgagttggagatagaggtaaataaggtatggtttttgtttttagggtttttttagttaagagggtatagggtgtgaaggggtataggttagaaggtgaaggtaggggttagggaaggtttttggaggaggtagaatgagatttaaagggtaaatagttggtgttgggtggtaggtaggtagatataagttttagtgatgatatagattatgttgaaaggaagaatagtgttaatagaattggtttggatgagggtagaattagaaagaatttagattttgatattttaagttgtgtgattttgatttagttatttttgtttttttatttattaagtaggtataatgattgggtttttttttaaggttgttgttataatttaatgagattatatttgttaattttagtgtagtatttggtattattataggttaaatatttttaattttaaattttgaaattggaaatgttttaaaatttaaagttttttgagtgttattatgatgtttaaaggaaatgtttattggaatattttagattttggatttttggattagggatgttttatttgtatgtattttgtaaatattttaaaatttgaaaatatttgaaatttaaaattttttttgttggaagtattttggataagggatatttaatttatattattattaatttatttttattaataatatgttgttatatttgtttttttgtttttttttttttttttaaggatatgggtatatttatattttgttattaaatatattttgtttataaatatttttagtaatatattgaaatatttatttgaagtattatgataaaagaaatgtggtattttatgtaatattttggggagtattggggaatttgttttgatagttatataggtttttttttattttttttaagtgttagttagtttgagaaataaagggatagagtttaaaagagagaaattttaaagttgggtgtttgggggagatattatatgttggtaggttttgtgatgttttataagttgtaaaattagtaagtttttattagggatttttaaaaggggagggaatgtatgaataggtgtgggttatagagattatgtgttttataaggtaatagaatattataaggtaaatggaggtagggtgaaattataggattataggatgggggtgaaattaaaattgttaataaagttttgggtattattgtttttgataatattttattaggagatagggtttgagagtaattggtttgattaaaatatattaggtaggaattttttttttttaataagtttgggagtgttatgggagattggggtttattttatttttatagttttaattatagaagatagttatatttaagggggttattttagagatttatttttaggggtatatttttttttttagggatgttttttgttgagaaaaagaatttagtaatattttttttatttgtttttgaaagaagagaaatatggttttgttttttttggtttattggtggttagagtttaaggttattttttttattatttgaataattgttgttattttgttttttttttaaggtgtttagattttatattgtttaaatatatatgttttataatttgtgtagttaatataattattatagggttttgaggtaatatatattttttttagtttaggagatgataggattaagagattaaagtaaagataggtataggaaattataagggtattgattggggaagtgataagtgtttatgaaatttttataatttgtgtttagagattgtagtgaagataggtataggaaattatagaagtattaatttggggaattaataaatgtttatgaaatttttataatttatgtttttttgttatggttttagttggtttttttgtttggggtttttgattttttgtaataggggagattatagatatgttattaattataatggttttttttagaatattagtttttaattgggtgattttggttttaggggatatttggaaatttttggagatatttttggttgttatagatggaaagggagaattttattggtatttagtgggtagaagttagggattttgttaaatattttgtaatgtatagtatagttttttataataaagaattatttggtttaaaatgttaatagtgttgaggttgagaaattttgttttagatgtaatttagttattgtttttttttaataattattgggaaatatggtaaaattatgttttttaagattttaaatttagttgtaaaagtgtattttttggatattttatatattttaatattttttttgaaaataaagttttttagagaatttggtggaattattttaattttttttgttataaagataatggaaattattttattttattattttttttttatatgtataatttaggataaatttttttttttttatgtggtaattttaatgaaatttattaaaaaagatatttgattaattttagtttgggagttttttttagagtagagaaaattttggaaatttgtaatagtgtgggtttttttttattattatgggggatataaatggttagttattaatgatggtttttgtagtttttggaggagagtgttaagtgttatttttgagtttttatagtttttttaatatttttgttaaagtggggttaataatagggggtttagaagggtttgtatgtttttattattttttattttttatttttttttttttagaagtaatatagtgattaagagtgtgggttttgggtttgaatttggttttgttgtttgttagttatagtgattttgataaattttttaatttttgtgtgttttagagtttttttttgtaaaatggggggaaataatagtatttattttataggattgttatgaggattaagtgagtttttatgggtagagtatttaaaatatagtttggtatatgggtgtggaggtttatatttgtaattttagtattttgtgaggttgaggtgggtatattatttgaggtttggaattgaagattagtttggttaatatagtaaaattttatttttattaaatgtgtttgtaattttagttatttgggaggttgaggtaggagaattatttgattttaggaggtagaagttgtagtgagttaagtttatattattgtattttagtttgggtgatagagtgagattttattttaaaaaaaaaaggatatagtttggtatataataagtagtaaataaatgtgagttgttttttttattttttatttttatttgtttttgtggatatattgaagtaggttttaggtatgatatggatgtggtggaagttatatgttattgtagagtatggaatatagttatagttagggttagttggggttaaggtagggagtggttgaagtggtgtttattgttttattaggtttgttttttttttagtttagtaatattttgtgtttttttttttttatgatttttattaatatttagtttttttttattttttttggtttttttttttaagtatgatattttattaagttttttttatttttattttttatagagttttatttggttattttttgaagtattgatttttatttgagttgtttattagattatttgggaatttgtttaaagtatagatatttgggttttgttttttaatgattattttaagtattttgattttagtgtttatttgagagatagtatggtatagtatttaagaatatgattaaagagttaggttgtttaggttatgggtttgttgtatgattttgagaaaattatttaattttttgttttttattgtttttatttgtaaaatgggggtgttatgttttgaatgtttgtgttttttttaaatttttgttgaaattttaattttatggtgatggtattaggaggtggaatttttgggaggtgatttggttatgagggtagagtttttatgaatgggattagtgtttatataaaagaggttttagggagtttttttatttttttttattatgtgaggataaagtaagaagagaagatggttgtttatttgtaaattaggaagtaggtttttattagataatagttttgttagtgttttgattatggattttttagttattagaattaagagaaataaatttttattgtttataatttatgtagtttatgggattttgttatagtattttgaataaattgaaagtaagagtgtttattttataaggttgtaagaataaatgagatgttttttaaaatagtgtttggaatgatttttgttttttttgtttattttttttttttttttatttttttatttggtttttttttttttattatttttttttttttttttaatatatatatattgttttattttagtggttttatatttgtaggtttttgatttaggtttttaatttaatttgatttgatttttgtatatggtaagagatgatattggtttggttaaatattttttgaataagatattaaaagtatagttaattagtgtaaaagtggataaatgagattattttaagttaaaaggtttttgtatagtaaaggaaattattaataaagtgaagagataatttatagaatggaataaaatatttggaagttatttatttgataagggattaataaatagaatatataagttgtgtaaataatttaataggaaaaaataatttgatttaaaaatggttaaaagatttgaatagatgatatatgaatggttaaaaatatttaatatttttaattattagagaaatataagtttaaattataatgagatattattttattttagtgaaaattgtttttattaaaaagatagggaattatggatgtttttaaaagtgtggagaaaggggaatttttatatattgttggtgggaatgtaaattagtatagttattatggagaatagtatgaaggtttttaaaaataataataataataaaatagagttattatattatttagtaattttattgttggatatatatttaaaagaaagaaaattagtatattgaagagatatttgtatttttatgtttattgtagtattatttataatagttaaggtatggaattaatttaagtgtttattaatagatgaataaagaaaatgttgtatatatatataatgaaatgttatttagttataaaaaagaatgaaattatgttttttttattaatatggatggaattggaggatattatgtaagagaaataagttaggtatagaaagataaatattatattttttgtttatatgtgggaatttagagagagaaagaatagaatgatggttattagggtttgggaagggtagtggggaggggggataaagagggggtgtttaattgtatatttttatttgtaggtgggaattgaataatgagaatatatggatataggaaggggaatattatattttggggattgttgtggggtgtggggaggggggagggatagtattgggagatatatttaatgttagatgatgagttaatgggtgtagtgtattattatggtatatgtatatatatgtaattaatttgtatattgtgtatatgtattttaaaatttatagtataataataataaataaaataaaaaataaaaaagaggggtgtttaatggatatgaaaatgtagttagatatgaggaataagatttagtgtttagtagataatagggtgattatagttaataaaaatttattgtatattttaaaataattaagagtggaattgtaatgtttttaatataaatatattataaatgtttgaggtgatggatattttagttattttgatttgattattatatggtgtatgtttgtattaaaatgttatatgtattttttatatatttgtaatttttatgtatttataataattaaaaataaaaattttttaaaagaaaaaaaatttttatatatttatggttttaagtatggttttgggatttagtaatgaattagatgtaattttagttttatatggtattatagtttaattagtggaaaatagatatataaataaataaagatatgtatgtgtataatgtatgaatgagagagttattgatttttttagaaaagagaagggagagatgaaaggttttaaaggggaaatgaatatggtattgagtgttagaatagagatgaaattaatttattttatgtaataaatatttttaaaagtatttattatatattaagtataggttttagtgtttttttgaaattgtttttttttagagagtggtagttttatttttaatttgatgttttaaaaaaatatttaatttaaaatagtaaaataatttataaaaaaaggtaaagtttgaggatttataaaatgtattattatttatatattataaagttgtagtaattaagatagtgtagtattggtatgaggataggtatttagattagttgggtagaattgagagtttagaaatttatatgtttatagttaattgattttttataagaatattaagattatttaatgaggaaagaattatttatttaataaatagtattgggataattggatagttatatgtaaaagaatatttaaaaaattaatttaaaatggattaaaaatttaaatgtaaaagttaaaattataaaatttagaagaaagtatgtatgtatattagaattttggattagttaatggtttgttagttataatattaaaagtataagaaaaaaatagttaaattggattttattataatgaaaaattattttgttttaaaagatgttgtgaagaaaataaaaagataatttatagaatggttgaaattgtagataatgtatagaaatggtagaatttgtaagttatatatttagtaaaggtttagatttagaatatataaagaatttttatattttaataataaaaagataattaatattttaaaaaaaggtaaatgatttgatagttttttaaagaagatgtgtaattagttaataagtatataaaagatgtataatattattatttattatagaaatgtaaattgaaaatataggagatattattttatatttattaggatagtaataattgttttttaaaaaaaggaaaataaatgttggtgaagatgtggagaaagtggaatttttatatattgttagtgaaattataaaatggtttagatattgtggaaaatatattggtagtttttttaaaaaggtaaatatagagttattatatgatttagtaatttaatttttaggaatttatttaggagaaataatatgtttgtttaaaaatttgtatatgaatgtttataataatattatttataatagttaataagtggtaatagtttaagtgattagtttatgagtggataaataaatatggtagatttagaggataaaatgttatttagttataataggaaatgaagtgtggattgatgtatgttataatatggagaaatttttaatatagtatgttgagtggaaggtgttagatataaaagattatatattgtgtgattttatttatatgtaatgtttatggtaggtaaatttatagagatagagaaataattaattagtggttgttagggggttagggaaaagggaattgggagtgattattaatagaattagagtttattgttggtgtgatggatatgttttgaaatttgatagtggggatggttgtataaaattaagaatatatttaaatttattgaattgtattttttaaaatggtaaagtttatgttatgtgaattatatgttaatagttataataaaaattattaattaatatatgttttttattttttttggaatgttgatatattgatataaattagttaaaataataaagtatgagttatgttattaatatttgttttataaaaatatgtgttttgtattttagttgaaaagttaaagtttatttagattatgattaggagtaggtagaggttaagggaaggttaagtttaaaggatttagttgttaagatttttttgattaatttttaaatttttatatgataatttatttgtttagtaaagttttgttttgaaaaaataatttttattaaaatgttatggtataaaaattagtgggttaaattttgttttataggtataaattagttattttgaaatatgtatgaatttttgtgatgtatagaatagttgtttggttgatgttgatttgtgaggttttgatgtgttattgtagttttttagtgtgttttttggtgaagagggtattaatagtatttgtttttttttttttaaatgtgtttttatgaagtttattttttgggaggattatttatgtgagtggatgttagatttgtttataagtttataaattatatagatttaattttgtttattaaagtaggtttttttttttatttttgttttttttgaagagtttaaaagttaaaatattagttttaatgaattttttattatattttagtaagtttaatatttttaattttagaggaagaattttagtttgtattataagtaagaaatagtatttttattattttgtgtgataaattgtgtttttattgattattttattttagatatagtttagtattttttttttatagagattttaggaaatgatagtatagttttttaatagtgaaaatataaatatagattttgaagtagtttgtggttttagtatgtgggaatgattagttatattggggattgttttgatagtagggtgggttgggggaattattttgagaggttaattatgaaatttatataaaatggatgaaaagttattttaatggatagaatgataaataaggtaagaagaagaggggaaagatagttggtaaaataaattttagtagtgttttttttagtattatttaggaaattataggatttgggaatttttattttagtgggaaggttgtagttagtgttgtaaataaatatggaggatttgttagtaatattgtttttttgtaagatggttgtattaggttttattaatttgataatattaaaattagatttttttgttttttttttttttatggatttaatgtttattagtaattttttgaatatgttttttatgagatattatgttgtagtggttaggtatttatattttggtttatattgtgtgggtttaaattttatttttattatttattagtattgtgattttataagtttagaatttttgattttatttataagagggttttaattataatttttattgatagatttgtgaggttattatggaaaatgtttgatattgtgtttggtataatgttattgttaataaatgttaattattatggttattgttattttaatataagtatgtttatgaaaatagaatgggttttttatatgtggtaattatgttttttattaaaaattattaaaatgggttttttgatttaatatgttaattatttgaatttagtgtaagttttataggatttataagaaaagaggatttataggtgaatagatttaggtttttgattttgttaagttaaggttatggtaaatttattaaggttataaaaatgttattttgtgaagttttttggggtttgttttttggtttttttttgaaaatgttattttatttaggagtttgtttttaatttttttaagaggagattttatagaggaagtaataaaatgggattaatggtttatatggtgagtgaatgttgaaatattgatttgttgaggattgagtttttgtaatttaggttatatttttttttaaaattttttaaaggttttttttttgtttttaggataaaatttaaattttgtgttagagttttataaggttttttttttttgattttttttgtttttttaattatgttttataatttttttttgttttattatgttttagtttaggggttggtaaattataggaaagtttggtaatattttattggaatatagtatatttttttgtttaagtattgtttatggttgtttttatattgtaatggtaggtttgggtggttgagatagatatatatggttttattgtaattgtatggtaatatttaattgtataggatttgggaagttaggtttagttgtgagtttaagaaaaggaaatgattttgtttattagttaataatttttgttataaaagtaaagtaatgtgagtgggggttttaaaaatttttattgtttttgttattttgattattatttattttttattaaaggtttttggggtatattttgtagattttattattttagggtatatattttgaaaagggttgattttgttaatttgatttggtattttgattaaagttatttttatattttgattaaagttataattgtatgatataggtatatttttattattagtgttttaagaatatgaaatgggaagttgatgatttttaaattattttatattgagtttaaatttattgtttaataataaataataatgataataatagtaatagatgtgtattatttatatatattattattttattttatttttatttatggtaagtgtttttgttatttattttatagatgaggaaattaaggagaagagaagttaagtaatttgtttaggttatataataggaagtaatgaataatggatttaggatttaaagttagtagtttgattattgagtataattaattaattttaattataaaattttattatatggttaaatgaatattttatttttgtgtagtagtttatagttataaattggtgagtatttttattttttatattagaaataaaggtatgaaaatgttaagagatttggtaaggttatgtagttattttttaggtaaaagaatattaggaatttggtttttggatttttttgtttataaataaaatttaaatttgaattgtatgtaattatttttgttatggtagttatgtatttagaatttggtgggtattaaattagaataaattatttggatggtattttagttataatatatttaaaataaaaagagttaaatatttataaagaaaatgagaggtaatgtaataataataaaagttggaaatgattttaatattaattagtagaagaatggttaaattaattatattgtatttataagatgatgttattaaaaattatggtttttggtttggtgtggtggtttatgtttgtaattttagtattttgggaggttgaggtgggtagattatttgaggttaggagtttaagattagtttggttaatatggtgaaattttatttttattaaaaatataaaaaaattagatgggtatggtggtaggggtttgtaatttttgttatttgggaggttgaggtaggagaattgtttgagtttgggaggtggaggttgtagtaagttaagattgtattattgtattttagtttgggtgagagagtgagattttatttttaaaaaaaaaaaagaaaagaaaagaaaaagaaaaagaataaaaaattatggttttttaataatatgggggaatgtttataataaaaataataagtatatatgtttgtgtatatataaaaatatatatatatatatatatattaattttattttaaaatatttttatgaattttatgtttttatattagattatgtttttaaattttattaatgtgtattgaataattttataggaattgtattaaaatatttattatggatatttttggatgtgagatgatggtagatttttttttatatatttttttgtatttttttattttttttagtgaagatatattatttttatgagtaggaaagttttatggtatgtgttgttatatagattgaatgtttgtgtttttttaaaatttatatgttgaaattttaatttttaatatgatggtattaggaggtagggtttttgtaagtaattaggttatgaaggtggagttttatgaatgggattagtgtttttatgaaagagttttggaagagtttttttatttttttagttttttgaggatagtgagaagatagtgggttatgaattaggatgtaggtttttattagatattggatttgttagtgttttgattttggattttatagtttttagattgtgagaaataaatgtttgttgtttaagttattaaatttatggtatttttattgtagtattttgagtatattaagatatatgttattttaaggaaagatgttaatattttgttttttatagtttgtttttttagtaagtttttattgtgtttaggggtgttgagtttttattgtaattattaaaaatatagttttatattataagtaattttgtttaggaatttttagttgattattagtattaaataaatgtattttgaatttagttatttatataaatgttgtttatgtagagatgtgggaggagagaggagaaggttatgatttttttgtggttttatgggatgtattgtttggtttttttttggggttataggggtataggtttagatatggtttaggatattagggttttgggattgggtaagaaatgtggtttaggagtttttggggagagagatgggttatatttttttttagtgtatttattttttaatagggtttaggaatttttagagaaaggattgaaattttgtttattaatgtattgtaaatttatgtttgagaaagtagggtgtttttagatggagaatagattatagagaagaataagtgtttttattgaagaattaaattggtattataattttaataagaaaaattggtgttatgtatgtttttatttataagtgggagttgaataatgagaatatgtggatatagggaggggaatattatatatttgggtttgttagggggtggggggtaaggggagggagagtattaggataaatatttaatgtatgtgaggtttaaaatttaggtggtgggttgataggtgtagtaagttattatggtatatgtatatttgtgtaataaattggtatgttttgtatatgtattttagaatttaaagtaaaataaaataaaataaaatagaaaaagaaaagttggtgttagtagagagtgggggttataggtagttttttagttgatattaaaatttgtttgtatatagttattttaggggtatttttgtagttttggagaaaggtgtagtgggttgatttggaagaataataattttgtaaaaggtagtaatattatggtttaattagttttgtagtggggtttttggatgagtggattataataattattatagtaattatattttttggttttgaatgatatttatatgggtttgggaatagagatgattttttttgagggggtggtggtagttgtaaagttgataggagtggagttttaattttggtgggggtggaggagtagaatatgtgtatgattattagggttggtggtaaaaattgttttgtttggtttagtatgtttttagtgaggaagttttgttatgagttattagaatatttgggattgggtgtatttatagtgttagtttagttgaatgtagtattaagtgtgtttattttattttgttgagtgggaggtgatattggattagtgatttggattgttgaattatatatttaaaatatgtaatgtgttaggttaaaagtgttataaagaaataaggttataataaggtagtaaggtatttagtatatattttaaatttataaatattggttttgtaggatttttaggtgatggtgattgtggtggtaatggggatggggatagatttttagttttgaggggtatttttgtggaaatattagagttttggtttatggatttttgttatagtggggatagaagtgaattatttttggttgtatgttagtatttttaggtatttttagaaatatttaggggaaagatattttttaaaaggttgaggtaaagtagggatatttaaaattggtgaagtgtgagatgtttgggatgagtttgtttaaataaagtaagttaaaggggttattaaagtgtatggttttttatgaatttaatgtttttttttaagtaatttaatttttgtggttatttgttatagttattttaaggagttgtttttggaagtttttatttttatgaggtgtaagaaaaattatgatttaggtaaatttgttaatatttttttatagaaagtttatttttagaggttttttttattgggattttttttatttgtttatagtttattgagtaatttattgattattgtgttttttgttttatgtttatttgttttttttttttatttaaattttaattagttttaatggtagaaaagtgatttgatatataatgttatttaaaaggataaatgattgatagtagtttgatttagtttttattttaaaggaggatgtttggagtttataatgttttaatggaaaggaattgggttaattgtgtaatttttttaataaggtaggttattggtgggaggtttttgggtaggggagttttttggaatttgttaatgatatattttaaaggtaatttaattgatttatgaagttaattttgatggtgttgatgatgttattaagaagttttaagtttgtgttgtttaaagtttatagagttttatttaatatatttttttgagttaggtagagaagaaatgattattttttattaatagtaaggatattgaggattggagattatttttatttgtttaagtgttttagttagtagttgatggaaatagtattaaatatatatatatataatttatttatttaaattatatatatatataatttatttatttaaattatatatatatatatatatttaattttattttgtgtgggtaaataaaggtagaatgtttaagataaggttgtttattttggttgttattggtattttggaataatattaagttgtaaggggtttaagattagttaaattatttgatttgtaagttttttttttttttttattttttatgtttaattttttagtaatttttgtaggtttaatatttaaaataaatattttttattattttattgtttttttttatttgaggttttattttttttatgtagatggttatggtagttttttgattgttttttttttttttatatttgtttatttatagttaattttttatatattagttagagggattttgtttaaatttaaggtaggttagggtggttttttgtttggaatttttagtagtttttttttgtaggtagagttaaagtttagtttgtatttggtttttggttgttttgatggttttagttttagttttttttgttttagttagattgtttttttttttttttaaatttgttatatatttttttattttagggtttttttattggttatttttgttttgttttttgagttttttagatatttatataattggtttttttattttatttagatttttgattaaatgttatttttttagagaagtttttttgttattattatttttttagttttttattgtgttttagttttttttatagtattttttatttaatatattatatatattttaaaatgtgttgttttgtttttttttttagttggaagttttatgttagttttgttttgttttttgttgtatttttattgtttataatagtatttggtatatatttgttgaataaatgaaattgagaaatttagagtaaattatttttttttagataaagtttataaaaatgttttttttttgtttagtttaaattatttagtatataatattagttttgtgattgtttttttttttgatgttttgatttttgagtgatttttaataagtaattttgttagaatttattttatttagttatagaatgggaataaaaatataatttatttttttttttagatattttaatgaagtaaagttttttttgttttttgaggaaaggagttaggtagatgaaaatttttgttattaaggtataattaaagtttgaggagggtaggagttgtattttgtttttttttatttttgtatagagaaggtatttattaagtgtttattaaagttaatatttgtggtatataaattgtatttgtttttgtagtagttgttatagaagttggttttttttttgggttaattgttttgagagtattagaatgaaatttgatttagatatgatgtagatttttttttttagaagaagttagttatataatttttgatgaataaatagttattaatgatgagtataaattagagaattttagaagtgaagaaaattttagattagaagattttgttttttgggtataatttttttttttttggagagaaatatagtgatttttttaattatggtgaattttttagtttagtttagagttattgatttagtagatatttttttaggtagattttaatggaaattaatatgtgaggtttgatgttgggaattttattatgtttaataaggatttgaaaattaaatgaatgtgtgtatatttatattaagtaatttttttttttgtttttattatttttttttttttttttttttattttttttttgtttttattttttttttatttatgttttagtgtttttgttggatatatgtgtattttatggttttgtagggtttgaaagatttttgattttttaaggtttagtgatttggtattagaagatttaagttttttttttttttttgttatttaaagaagtgtgttgtaatttttttagtagaagtgaaagtgatttgtttttatttaaatgtttgtataggtataagaatgagggtgagagggagtaagagaagaggaagaggtattttttgaatggggtgaaagtaaatttttatataatttgattatataataggaggaaatgaaaatttgggtttaagggtaattttgttattggttattagtttgtgttattaagtaggtgttagaaaaataaattttattttgattttaggtatttattttaataattggatttttttaattttttatttttaaggaggatttatgtaagaatgtataatttatagttaatttggagatgaataaaatattaatatattttttgttttttttaaaatataatatttaaattagtgtgatgttttggttattattttatatatgtatttggattgtaaatgagtttagttttaagtatatttgtaatagtggaataagtgaggtttgtattatatggttaaattgatattaatgatggtggttttgagaatggattttattttaagatatttgatttgtagatagttgagtatttatagtagttttgattttattgattttattggttttagttagaaggtttttatttagtgtatttagttattttgatttttaattataatagaattttttaaatagatttgtttttagagagtttgtttgagatagattaaatggtagaagttgtaaaggatgttattgttttatataaaagatttgtggaaattatgtttagaaatttgttgtttttttattttaaaagttgttatatataaaataatagttagggttaaatagttattattgtgataataattatttatggtatgtttgtaattgttttaaaaagttaatatggaaaagttattagaattaagtggtgatgttttatttaagaagtagaaaagatttataatttattatggatgtaaaaagaaatggattttaagaaatttgttattgtagttgttgaaagaatattgttaaagtgtttatttatattaagtggttttatagaatgtagtttttttagattttagtgttagtttttataaaattgttggtttgttttaattttttggaaattataggtgtttttttttaatattagtgattatatttttttttgtgtttttgttggtaggaagtttagagtttaatttataatttttaatgatttttattgaattttatatttgtattttttttagttttttttttttagggtgggaatagggttttattaatttttttttggatttatttgttttataatatttttttttattttgatttaattgttttttttttttttttttatgatatatgtttttaaaagttggtatgaagtgaaatggagtatatttggttttaaagtgataaatttaatatatttaaaattattattttagtgtgattatttattttattttattattgttttagaataatgtatttagaatgttgtttttttttttgaagttttaaaaattatttaatttttttttgaattagtgtatattaatgtttatattttaattttttatattttgtttgtttttattttttgttttaaaagaaattaatgtgtattgtgattttagtttttattagttattaatttggggattaatatgattgttttattgttagtgagtatttttttttgatagttttaggaggggtgattaattttatttgatttattatgtttttttattttgtttgtttagtgattatggttttgtatttttttgtatttatttttttattatttaatttaatttaattatttattgtttgattattttgtattttttttttttttgttttttgtatagaatttgttattttttttttgtttttatttagttttttttgttggttttttattttttttatattataatgttggagtgttttagggttaagtttttgggtttttttttttatttgtaaatatttttattttggttggtttgtttaatttaatggttttaaattaaatttttatattgaagattgaaatttatgttagtaatttggatgttttttttgaattttagatttatatatgtaatagtttatttattatgttt

SEQ ID NO: 249 - DNA, 159782 bp, Artificial Sequence
  Chemically-Treated DNA
ggatatgatgagtaggttgttgtgtatgtgagtttggagtttggaagagatatttaagttgttgatataaattttggtttttagtgtagaaatttgatttaaagttattgggttaaataaattaattaaggtaagagtatttgtaggtaagagaagagatttaaggatttagttttaaggtattttagtattatgatgtaggggagatgaggaattagtaaaggaggttgaatggaaatagagaaggaatggtgagttttgtgtaagagataggaagaaagagaatgtaaaatggttaaataataaataattaagttgaattagatggtaaagaaataaatgtaaggaaatgtaaggttatagttattgggtagatagagtaaaagaatatgatgaattaggtgagattaattattttttttggaattattagaaaaagatatttattgatagtgaggtagttatgttagtttttaagttgatgattaatggaaattaaggttatagtgtatattaattttttttgaagtaaaggataaaaataaataaaatataaaagattaagatgtaaatgttagtgtatattaatttagagaagaattaaatgatttttaaaattttaagaaggaggatagtattttaaatgtattgttttaaaatgatagtaagatgggataaatagttatattagggtgatgattttggatgtgttaaatttgttattttgagattagatatgttttattttattttatgttagtttttaagaatatatattatagaaaaagagaaaagaaatagttgaattaaagtgaagagaaatattgtgaagtaaataaatttagggaaaaattaataaaattttatttttattttaaaaaaaagaaattaaaagaagtgtaaatataaagtttaataggagttattagagattgtaaattgggttttgagttttttattaataaaagtataaaggaaaatatgattattggtattaaaaaaaaatatttatggtttttaaaagattaaaataaattagtagttttatagaagttaatattaaaatttaaaggaattatgttttatggagttatttaatatggataaatattttgataatatttttttaataattatagtaataagttttttagagtttatttttttttatatttataatgaattgtaaattttttttattttttaagtaaaatattattatttaattttggtaatttttttatattaattttttagaataattgtaaatgtattataaatgattgttgttatagtggtaattatttgattttgattgttattttgtatatagtagtttttaaaataaaaaggtaataagtttttaggtgtaatttttatagattttttatgtaaaataatgatattttttgtaatttttgttatttaatttattttaagtaagttttttggaaataaatttatttgaaagattttattgtaattagaaattagggtaattgaatgtattagatgaaaattttttgattggggttaatgaagttaataaagttaaaattgttgtgaatgtttaattgtttgtagattagatgttttgggatggaatttgtttttgaggttattattattaatattaatttggttatgtaatataagttttatttgttttattgttataaatgtgtttaaaattgagtttatttataatttaaatatatatgtaggatggtaattaaggtattatattaatttaggtattatgttttagggggaataaaaggtatgttaatattttatttatttttaaattaattataaattgtgtatttttgtatagattttttttgggaatgagaaattaggaaaatttagttgttaaaatgaatgtttaaaattaaaataaaatttgtttttttggtatttgtttgatgatatagattaataattaatgataaaattgtttttgaatttaagtttttatttttttttattgtgtggttaggttatgtaagggtttgtttttattttatttaaaaggtatttttttttttttttttgtttttttttgtttttatttttgtgtttatgtagatatttgagtagaggtgaattatttttatttttgttggggaaattgtaatatgtttttttaaatggtagagagaaggagaaaatttagattttttgatattaaattattggattttagaaggttagaaattttttaagttttgtaggattgtaaaatgtgtatgtgtttaatggaagtattggggtatgagtggggaaggaatagaaatagaaagagggtaagagaagaaaaaagggaaagtggtgaaggtagggaggaaaattgtttagtgtgaatatgtatgtatttatttagtttttaaatttttgttgagtatgataaaatttttagtattagattttatatgttggtttttattaggatttgtttgggggaatatttgttgaattagtggttttgagttgaattaggaaatttattataattaggagagttattgtatttttttttaaaaaaaaaaaagttatatttgagagataggattttttgatttgaaattttttttatttttgaaattttttggtttgtgtttattgttggtagttatttgtttattaagagttgtgtagttggttttttttgaaaaaaggaatttgtgttatatttaagttagattttattttggtgtttttagagtagttagtttaggaaaggggttagtttttgtgatgattgttgtagaggtaggtgtagtttgtgtgttatagatattaattttgataagtatttaatgagtgttttttttgtgtgagaatggggaggaataaaatgtagtttttattttttttgggttttagttgtattttaataataggaatttttatttgtttggtttttttttttaaagaataaagaagattttgttttattaaagtgtttgagaaggaaggtaggttatatttttatttttattttatagttgggtaaagtgagttttaataaagttatttgttaaaggttatttagaggttagagtattagaaaaaaagataattataaggttgatgttgtgtgttggatagtttaaattgaataggaagaaaatatttttgtgggttttatttaaaaagaaatagtttgttttgagttttttagttttatttatttagtaagtatgtgttaagtgttattgtaggtaatgaagatatagtagggaataaaataaaattgatatggagtttttaattagaaaggagaatgagataatgtgttttaaaatatatataatgtgttaggtaaaaagtgttataaggagagttaaaatataatgagaggttagaagagtgatagtggtggaggggtttttttgaggagatgatatttgattaggggtttgaataaagtaaagaggttagttatgtgaatatttggaagatttaaggggtagggtggaaatagttagtagaaaggttttgaggtaggaaggtgtgtggtaagtttgaggaaaaggaaagatagtttgattggagtaaagagaattggagttgaggttattaaggtagttaggagttaggtgtagattgggttttgattttgtttgtagggaggaattgttgaaggttttaagtaaaggattgttttgatttgttttaggtttgaataggatttttttggttggtgtgtgaagaattaattgtagatgggtaagtgtggaaggaaggagagtagttaggaagttgttataattatttatatgagagaggtaaggttttagatggaggggagtagtggaatggtggaaagtgtttattttgaatgttaagtttgtaggagttgttggaggattggatatgggggatgagaaaaagagagaggtttatagattaggtaatttagttgattttaagttttttatagtttaatattattttaaggtgttaataatagttaaggtaaataattttgttttggatattttgtttttatttgtttatataagatgaaattaaatatatatatatatatataatttaaataaataaattatatatatatataatttaaataaataaattatatatatatatatttagtgttgtttttattagttattagttgagatatttgggtaaatgagggtgatttttagtttttagtatttttgttgttaatgagagatggttattttttttttgtttagtttaaaagaatatgttaaataaaattttgtgaattttaggtagtataggtttagggttttttagtaatattattagtattattagagttaattttatgagttagttgagttgtttttggggtatattattaatagattttaggaagtttttttgtttaaaagttttttattaatggtttgttttgttgaaagaattatataattagtttaatttttttttattaaggtattgtggattttaaatatttttttttaaaatggaaattaaattgagttattgttagttatttgtttttttaggtgatgttatatattagattatttttttgttattagagttagttgaagtttgaatagggaaaaggaatgaatgaatgtggggtagagaatgtaatagttggtgggttatttagtaggttgtggatagatggagaggattttggtgggaggagtttttaaagataaattttttatgggaaaatgttgatagatttatttgagttatggttttttttatattttataaaaatgaaggtttttaagggtagttttttgaaatagttgtaataagtagttatagaagttgagttgtttaaagaaaaatattgaatttatggggaattgtatgttttaatagtttttttggtttattttgtttaaataaatttattttgagtattttatattttattaattttgagtgtttttgttttattttagttttttaaagagtgttttttttttaaatatttttggaaatgtttaagggtgttgatgtgtagttagaaatagtttatttttgtttttattatggtaggaatttatggattaaggttttgatgtttttataaagatgttttttaggattagaaatttgtttttatttttgttgttattatagttattattatttggaaattttgtaggattaatgtttgtgaatttggaatatatgttagatgttttattattttgttatgattttatttttttatagtatttttaatttagtgtattatatattttaaatgtataatttagtgatttagattattggtttagtgttattttttatttagtaaagtgagatgaatatatttggtgttatatttagttaggttggtattgtagatgtatttagttttaggtattttagtggtttatgatagggtttttttattggagatatgttgagttaagtaaggtagtttttattattaattttgatagttgtatatatattttgtttttttatttttattaaggttgaaattttgtttttgttagttttgtagttattattatttttttagggagagttatttttgtttttaaatttatataaatgttatttaaagttagaggatgtaattgttgtagtaattgttatagtttatttatttaggggttttattgtaaagttgattaaattatagtgttattattttttatagagttattatttttttaaattaatttattgtatttttttttaaggttataaaagtgtttttagggtggttgtgtataggtaagttttgatgttagttgggaaattatttataatttttattttttgttaatattaatttttttttttttattttattttattttattttattttaagttttgggatatatgtgtagaatgtgttggtttgttatataggtatgtatgtgttatggtggtttgttgtatttattaatttattatttaggttttaagttttgtatgtattaggtatttgttttgatgttttttttttttttattttttattttttgataggtttgggtatgtgatgtttttttttttgtgtttatatgtttttattgtttaatttttatttatgagtgagaatatgtataatattaattttttttattggaattgtagtgttagtttagttttttagtggaagtatttgtttttttttataatttgttttttatttgggaatattttatttttttagatataggtttgtagtgtattggtgggtaggattttagttttttttttgaaagtttttaagttttattgaaaaatgaatgtattggggaagggtgtggtttatttttttttttagaagtttttgagttatattttttatttagttttggaattttggtattttaaattatgtttgaatttgtatttttgtggttttagaaagggattaaatagtatattttatgaaattataaagagattataatttttttttttttttttttatatttttatataaataatatttatatagatgattgaatttaagatatgtttatttggtattgatggttaattggaagtttttaagtagaattatttataatgtgggattgtgtttttagtggttgtagtgaaggtttaatatttttaaatatggtgggaatttgttgaggaggtaggttgtgaagggtagggtattagtatttttttttaaaataatatgtgttttagtgtgtttaggatgttatagtaaaaatattatagatttggtggtttaaataataaatatttattttttatagtttggaggttgtgaagtttaagattaaggtattgatagatttagtgtttggtaaaggtttgtattttagtttatagtttgttgtttttttattgtttttaagaggttgaaagggtgagagagtttttttgagatttttttataagggtattaattttatttatagggttttatttttatgatttaattatttataaaggttttattttttaatattattatattgggggttaggattttaatgtatgaattttggggagatataaatatttagtttatataataatatgtattgtgaaatttttttatttataaaagtaatatatttttattggagaaagtaaaaaagtatagaaaaatatgtagaagaaaatttattattattttatatttagagatatttatggtaaatattttaatataatttttgtgaagttatttagtatatattaatagagtttgaaaatataatttaatataaaagtatgaaatttataaagatattttaaaataaagttaatatgtatgtgtgtatatgtatttttatatatatataaatatatatgtttattatttttattgtgagtatttttttatattattagaaaattatgattttttgtttttttttttttttttttttttttttttttttttttggagatggagttttatttttttatttaggttggagtgtagtggtgtaattttggtttattgtaatttttattttttaggtttaagtaatttttttgttttagttttttgagtaatagggattataggtttttgttattatgtttatttaatttttttgtatttttagtagagatggggttttattatgttggttaggttggttttgaatttttgattttaggtgatttgtttattttggttttttaaagtgttggaattataggtataagttattgtattagattaaaaattatgatttttgatggtattattttatggatgtaatataattaatttaattatttttttattagttaatattaaggttatttttaatttttattgttgttatattgttttttattttttttataaatatttggttttttttattttggatatgttgtagttaaaatgttatttagatagtttattttgatttagtgtttattaggttttaggtgtatgattgttatagtagagatagttgtatatagtttaagtttagattttgtttgtgagtgggagaatttaaagattaagtttttaatatttttttgtttgaaaaatggttatataattttgttaaattttttaatatttttatgtttttgtttttaatatggaaaatgaagatatttattaatttgtaattgtaaattattatataagaatgaggtatttatttaattatatggtgagattttgtagttaaaattaattaattgtgtttagtggttagattattggttttaaattttggatttattatttattattttttattgtgtaatttgggtaagttatttaattttttttttttttagtttttttatttataaaatgaataatagaagtatttattataagtgaggatgagataagatggtggtatatgtgagtggtatatatttgttattattattattattgttatttattattaagtagtgaatttagatttaatgtgaaatggtttagaagttattagttttttgttttatgtttttaaagtattggtgataagagtatgtttgtattatgtagttataattttaattaaaatatgaaagtaattttaattaaaatgttaagttaaattagtaaagttagttttttttaaaatgtgtgttttaaagtaataaggtttgtagggtgtgttttagggatttttggtggggagtgggtggtagttagaatggtgaaaatagtggggatttttagggtttttatttatattgttttgtttttatagtaaaaattgttggttgatgaataaaattattttttttttttggatttatagttagatttaattttttaagttttgtatagttaaatgttattatataattatagtggagttatatgtgtttgttttaattatttaagtttgttattgtagtgtgaaagtagttataggtaatatttaaataaagggatgtgttgtgttttaataaaatgttattaaatttttttatagtttgttagtttttgaattagagtatggtaaggtaagagagaattgtagaatgtggttggaaaggtagaaggagttagggaggaaagattttgtggaattttagtataaagtttggattttattttaaaagtagaagggaagtttttgaagggttttagaaaagggtatgatttgaattatagaagtttagtttttagtagattagtattttaatatttatttattatgtgaattattgattttattttgttattttttttgtagaatttttttttaaggaaattgaaagtaagtttttgaatgagatggtatttttagggaaagattaggaggtagattttaaggggttttataagatggtatttttgtggttttggtggatttgttatgattttggtttggtaggattagaaatttgaatttatttgtttgtaagttttttttttttgtaagttttataagatttatattaagtttaggtgattaatatattaagttaaaaagtttattttagtaatttttaatgaaaaatataattgttatatgtgagaagtttattttatttttatagatatatttatattagaataataatgattataatggttagtatttattaataataatattgtgttaggtatagtgttaagtattttttatgatgattttataagtttattggtaggaattgtggttaaaatttttttatagataaagttagaggttttaaatttataagattataatgttagtgagtggtagagatgagatttgaatttatatagtgtaaattagagtgtggatatttagttattataatatagtgttttataggagatatgtttagaaggttgttagtggatattgaatttatgggggaaaagaaggtagaaaaatttgattttaatgttattaggttaatggggtttgatgtagttattttgtagaagaatggtattgttagtaggttttttatgtttgtttataatattggttatggtttttttattaggatgggaatttttaaattttataattttttagatggtgttggaagaggtattgttgaggtttgttttgttaattatttttttttttttttttttgttttatttgttattttatttattaaggtgattttttatttattttatatgaattttataattaattttttagggtaatttttttagtttattttattattagggtagtttttaatatgattaattatttttatatattaagattatagattgttttagaatttgtatttatatttttattattaaaaaattatgttattgttttttgaaatttttatgaaaaaaaaatattaagttatatttggagtgaaatggttagtaagaatatagtttgttatataaaataatgaaaatgttattttttatttatagtgtagattggggttttttttttagaattagaaatattaggtttgttaagatgtgatggggagtttattggggttagtgttttagtttttgaattttttaaaaggaatagaaatgaagaaaaagatttgttttaataaataaggttaagtttgtatgatttatggatttatgagtaaatttgatatttatttatatgggtggtttttttaagggataaattttgtaaaagtatatttaagaaaaagggagtagatattgttggtgttttttttattaggagatatattgaaaggttgtagtagtatattagagttttataggttagtattagttaaatagttgttttgtgtattataagaatttgtatatattttaaaatgattaatttgtatttatgagataggatttgatttattaatttttgtattgtaatgttttaataaaaattgtttttttaaagtgaagttttgttgagtagatgaattattatgtgggagtttaaaaattagttaaaggagttttgataattaagttttttaagtttggtttttttttggtttttgtttatttttgattataatttgaataaattttaattttttgattagaatgtaaaatatgtgtttttgtaaaatgaatattaatggtataatttgtgttttattattttagttgatttgtattaatgtattaatattttaaagaaaatagggagtatatgttggttaataatttttgttatgattattgatatgtaatttatatgatataaattttattattttaaaaagtataatttagtgagtttgagtatgtttttaattttgtataattatttttgttattaaattttaaagtatatttattatattaataataaattttggttttattagtagttatttttaatttttttttttttagttttttggtgattattaattaattatttttttgtttttatggatttgtttattatgaatattgtatataaatggaattatataatatgtagttttttgtgtttggtattttttatttaatatattgtattaaaggtttttttatgttatagtatgtattgatttatattttattttttgttatggttgaataatattttgttttttgaatttattatatttgtttatttatttatgagttgattatttaggttgttgttatttattagttattatgaataatgttgttatgaatgtttatgtataagtttttgggtagatatgttattttttttgggtaaatttttaggagttgaattgttgggttatatagtaattttatgtttatttttttgagaaaattgttaatatgttttttatagtgtttgaattattttataattttgttggtaatgtatgagagttttattttttttatatttttattaatatttatttttttttttttaaaaaataattattgttgttttagtgggtatgaagtgatattttttgtatttttaatttgtatttttgtaatgaataatgatattgtgtattttttatgtgtttattggttagttgtatattttttttagagaattattaggttatttgtttttttttgaaatgttggttgtttttttattgttgaaatataaaagttttttatatattttagatttagatttttattggatatatgatttgtaaattttattatttttgtatgttgtttataattttaattattttgtgggttgtttttttattttttttataatgttttttgaagtagaatagttttttattgtgatgaagtttagtttgattattttttttttgtgtttttggtattgtaattaataaattattgattaatttgagattttgatgtatatatatgtttttttttaagttttataattttagtttttatatttaagtttttaatttattttgagttaattttttaaatatttttttgtatgtagttatttagttgttttaatgttatttgttgaataggtgattttttttttattgaatggttttggtatttttgtaaaaaattagttgattgtaggtatatgggtttttggatttttaattttatttgattgatttgaatgtttatttttatgttagtattatattgttttgattattgtagttttgtagtatgtaagtagtagtatgttttgtgagtttttgaattttgtttttttttatagattgttttgttattttgagttaagtatttttttaaaatattaagttaaaaatgaagttgttattttttaaaggaggataattttagaaaggtattgagatttgtgtttggtatgtagtaggtgtttttgaaaatgtttgttgtatggaatggattgattttatttttattttaatatttaatgttatgtttattttttttttggagttttttatttttttttttttttttttaagaaaattagtaatttttttatttatatattgtatatatatatatttttatttgtttatgtgtttattttttattaattagattataatgttatataaggttagaattatatttaatttattgttgggttttaaagttatgtttaagattataagtatataggggtttttttttttttaaaaagtttttatttttaattattatggatatataagagttatagatatgtaaagggtatatgtgatattttgatataagtatatattatataatgattaaattagggtaattgggatatttgttattttaagtatttgtaatgtatttgtgttagaagtattgtaattttatttttagttattttgaaatatataataaatttttgttaattgtagttattttgttgtttattgaatattagattttattttttatatttgattgtatttttgtatttattaaatattttttttttttattttttattttatttattattattatattataagttttagggtatatgtgtataatgtgtaggttagttatatatgtatatatgtgttatggtggtgtgttgtatttattaatttgttatttagtattaggtatattttttaatgttattttttttttttttttatattttataatagtttttagagtgtgatgtttttttttttgtgtttatgtgtttttattgtttaatttttatttatgagtgagaatatgtggttaaatattttttttttattttttttttttattattttttttagattttagtaattattattttattttttttttttttgagtttttatatatgagtaagaaatgtgatatttgtttttttgtgtttggtttattttttttgtataatgttttttagttttatttatgttgatgaaagagatataattttatttttttttatggttgaataatattttattgtgtatatgtataatattttttttatttatttgttggtggatatttaggttgattttatattttggttattgtgaatagtgttgtggtaaatatgggagtgtagatatttttttgatatattgatttttttttttttgggtatatgtttagtagtgggattgttgggtaatatggtagttttattttgttgttgttgttgtttttaggaatttttatattgttttttatagtggttgtattaatttatgtttttattaatagtgtatgagggtttttttttttttatatttttgagagtatttgtaattttttgtttttttgatagaagtaatttttattgggatgagatgatattttattgtagtttagatttatatttttttgatgattaaggatgttgagtatttttggttatttgtatgttatttatttagattttttgattatttttaaattaaattatttttttttattgagttgtttatataatttatatattttgtttattaattttttattagataggtagtttttagatattttattttattttgtgagttgtttttttattttgttgatggttttttttgttgtgtagaagttttttagtttgaggtgattttatttgtttatttttgtattggttgattgtgtttttgatgttttatttaaaaaatatttggttagattaatgttattttttgttatatataaaaattaaattaaattggattaaaaatttaaattgaaggtttgtaagtatgaaattattagaataaaataatatatatgtgttggagggagagaagaaagtaatgaagaaagaaaggttaggtgagaaagtaagagagaagggaaaatgaataagaaagataaaagttattttaggtattgttttaaggggtattttatttatttttataattttatgagataagtatttttatttttagtttgtttaggatgttataatagaattttatagattgtgtgggttataaataatagaaatttattttttttagttttagtgattgggaagtttatgattaaggtattgatagaattgttatttggtgaggatttgttttttggtttataaatggatagttattttttttttttgttttgtttttatatggtgggaaggggtaaagaagttttttgaggttttttttatatgggtattaattttatttatgagggttttgtttttatgattaaattattttttaaaggttttattttttaatgttattattatggggttaggattttaataggaatttggaaaggatatagatatttagaatatagtatttttattttatagataagaatagtgagaaatagagagttaaataatttttttaaggttatataatgaatttgtagtttaggtagtttggttttttggttatgtttttaaatattatgttatattgttttttaaataaatattaaaattaagatatttgggatgattgttgggaggtagagtttagatatttatattttaaataaatttttaaatgatttgatgggtaatttagatgaaaattaatgttttaagaaatagttaaataaaattttatggaaggtaaagatggggagagtttggtgagatgttatatttgggaggaaaagttagggaaagtaagagaaaattgggtattagtaaagattatggagaagggaaaatataagatattgttaggttaaaaaagaggtagatttgatgaagtagtgaatattattttagttattttttattttggttttagttggttttggttgtgattgtgttttatattttgtaatgatatgtaatttttattatgtttatattatatttaaagtttattttagtgtgtttataaaagtaagtaagaataaaaagtaagagaaataatttatatttatttgttgtttattatgtgttaggttatgtttttttttttttgagatagagttttattttgttatttaggttggagtgtagtggtgtgagtttggtttattgtaatttttgttttttggggttaagtgatttttttgttttagttttttaagtggttgaaattataggtatgtttagtagagatggggttttgttatgttggttaggttgatttttaattttagattttaagtgatgtgtttattttagttttataaagtgttgggattataggtgtgagtttttatatttatgtgttaggttatgttttaagtgttttatttatgagaatttatttagtttttataataattttgtgaggtaggtattattgtttttttttattttatagggaaggattttgaagtatatagaggttaaggagtttattaaggttattgtagttaataagtagtagaattagatttaaatttggagtttatatttttaattattatgttgtttttagaagaaagaaaataagggatgaaggatagtaaaaatatgtaagtttttttgagttttttgttgttggttttattttggtaggagtgttaggaagattatgggaatttaaaggtgatatttagtatttttttttagaggttataggagttattattggtagttagttatttgtattttttgtgatggtggagaaaagtttatattgttgtaagtttttagaattttttttgttttggaaaagatttttaaattagggttaattaagtattttttttggtgaattttattaaaattattatataaaaaaagaagaatttgttttgaattatatatataggagaaaaatgataaaataaaataatttttattatttttgtagtaaaaaaagttggaatgattttattaggttttttgaaggattttgtttttaaaggagatgttaaaatgtgtaaaatatttaaaggatatatttttgtagttgaatttaggattttaagaaatatggttttattgtgttttttaatgattgttgaaaagaagtagtgattgggttatatttagggtagggttttttagttttggtattattgatattttgggttgggtaattttttgttgtggggggttgtgttatgtattgtaggatgtttagtaggatttttggtttttatttattagatgttaataagattttttttttttatttgtgataattaaaaatgtttttaggaatttttaaatattttttagggttaaaattatttagttgaaaattagtgttttagggaaaattattataattaatagtatgtttatgattttttttgttgtgggaagttagggattttaaatggagggattagttgaagttatggtagaagaatgtggattgtgaagattttatggatatttattagttttttaaattaatatttttataattttttatgtttgtttttattgtaatttttaaatataaattgtgaagattttatggatatttattatttttttaattaatatttttgtgattttttatatttgtttttattttaattttttaattttgttattttttaaattgaggaggatgtatgttgttttaggattttgtgataattgtgttaattgtataaattgtagagtatgtgtgtttgaataatatgaaatttgggtattttgaaaaaagaataggataatagtaattgtttaggtaataagagagataattttaaattttgattgttggtgagttagggggaatagagttatatttttttttttttaaaagtaaatgggagaaatattgttgaatttttttttttagtaaggaatatttttgagaaagagaatatgtttttgagggtgggtttttgaaatggtttttttgggtgtggttgttttttatggttgaaattgtagggatgaaataaattttagttttttatagtgtttttaggtttattaggaagaggaaatttttgtttaatatattttggttagattagttgtttttaaattttgttttttgataagatgttattaaagataatggtgtttaaaattttgttagtaattttaattttgtttttgttttgtggttttgtgattttgttttgtttttatttgttttgtgatattttattattttgtgaagtgtgtgatttttgtgatttatatttatttgtatattttttttttttttgaaagtttttaataaaaatttgttggttttgtggtttgtggggtattatggaatttattaatatgtgatgttttttttagatgtttagttttaaaattttttttttttgaattttgtttttttattttttaaattggttgatgtttagggaaaatagaaaagaatttatgtgattattggggtaggttttttgatattttttaaagtattgtatggaatgttatattttttttattatagtgttttaaataagtattttagtgtgttattgaaaatatttataaataaaatatatttgatagtagggtatgaatatgtttgtgtttttggaagagaaagaggggataagagaataggtataatagtatgttgttggtgaaaataaattggtagtaatatagattgaatattttttatttaaaatgtttttgataggaagggttttggattttagatatttttagattttgaaatatttgtagaatatatataggtagagtatttttaatttaaaaatttaaaatttgaaatgttttaatgagtattttttttgagtattatgatagtatttaaaaagttttggattttggagtatttttgattttagaatttgggattagggatatttgatttatagtaatgttaaatattgtattaaaattagtaaatgtaattttattgaattgtgataatagttttaagaggaaatttgattattatgtttatttagtagatgaggaaatagaggtaattaggttaaggttatataatttggagtgttagagtttggattttttttagttttgtttttgtttaagttagttttgttaatattatttttttttttagtataatttgtgttattattggagtttatgtttatttgtttgttatttagtattaattgtttattttttaagttttattttgttttttttaggagttttttttgatttttgtttttattttttgatttgtgtttttttatattttgtgtttttttaattgggaaagttttgagggtaggggttatattttatttatttttatttttagtttattgtatagaggtatttagtagatgattagtaaatatgggttgtttagtaaaaattttgtagttagagataatgaaagaaatataattatttttgtgtgggttgagaaagaagggaagggaaagtttagatatttaagtagaaaaaggtaaatagtttaaaaggggaaaagtaatttgtttaaattatgtagttgagggtaggaagaaagggggataaagttaaaattaaaatttagttttttgttttagtttagtgttttgtttgttatgttatataaattgtgattgtgaaattaaagggtttttgatggtattgatataagtaaataaatggttttatgagttaatatatgataagtaataaatttataaaaggtaaatattgataattgaagattatatattattatgtttagtgtgtggagaatttaattaggaattaggaaagtttgtatatttagtttggttttttggtaaattaatgagattttaaataaattattttatttttttgtgtttttgttttttttggttgtagtattttgttggttaaagagtatgtgattaatgtttatgtttttaaatgtttgtttttatttgagtatgtttagttggatgtggaaaatttatggtttttttgggttttataaggattaaattttatagtgatatgtaaatttgtgtggtttatagaattataggattttaaagttgggagaggtttgataaattatatagtgaaaatttttagttagtgtttggattttttttatagaattttttttttattggataggtgttttttttataatttatgatgtaaggagaaaaggggttttgtttgaaggaagttagtgtattgtgtatgggtgtgtattttttgtttggggtgtgtttatagggttattttattttttgaaagtgtaataataagttattttattatgtattaattaaatgttagagattatgttaaatgttttatagagaatattttttttaatttgtataagaattttttgaggtagataatattattaattttattttttagataaggaaattaatatttagaaaagttaagtaatttgttaaagatatgtgtttattaggaggtagagttttaagtttattttaagtttttaataagtaaataaatgtttattgaatttaattaatgatattttattttatatttttttgttattgatgagagagagaagtataaagtttatgtaaataagatagaagtaatgttttatataagtattgtggatttaattttattaagggattgattttttattttaatggaattttttttttagttattaagttttagttttaagattgtaaatgttaagaagatattaaaatattttaatatataattttattagattatatttataggtattgttaatatattattaaatttattataaataaaataataaaataaaaggttggattaatatggaaagtagagtaataatttaggttttaaagaaaaattatgtaagatattttttagaggattattaggtttttttttttttttttttttaaatatagtttaaaatagaaaagtaatttatgtattaataaaaaaaatagaaatttgaggtagatgtaattagaataggtgaattaattgaagattgatatttttatttatgtttgtgtattttaaataaagaaggagtttgattattttatttagttaattattaaaaggaaatttgagttaaatttgtgaagtaggtaaagtttatttttagatatttaattggttttttttttgggtttttttttttttttggggttattttttatgtttggtaattttaatttttttgttttttttagaaggagtaatatttttatgttttagatttttatttttgatgttaggattttttttgatgtaagtgttagttaattttagttggttgaagaggaaggaggaggaagagaaggagggggaataatgtattgaagtgtgtaatagttaagtttaggagtagtttttattttaggatttagatatttatattatataattgggaatttatttttagatttttttgttttttttttttgtaaattttaatttaatggagtttttaagtggtagattatagttgttttaagtttgtattgtattagtttagttatttttgttgagaaataagataagtttttaagtagttttagaaagttaagaattaaggtgtatttgtttttgttatgtgtttatttttgatattattagatttggtttatgtagagttatagatgggttaatattattataagtgtatggattaaagttagggaaaggatagttttttaaaggaaatgttaggttttagtattatatgtggagaggggatatttggtaagtaaaatagtatttatttattatgtggttataatagggtagattagggtttttggtaggatggaggtagttattaagtattatggtatttttgaataatttttttttagtttatatgtaaattaatttttttaaattgttaatgtatttaatataaggatggatttagtaaaattgtattaatagtaaaatatgaggggtttttagttagtagtttgttttgtatagttatttatgattattgttttaattgattttttttagaatgtttaaaggaagatgaaagtagaaaatgagttgtagtggataagtatttttaaaatgagtttaataatgtagtatttttgggtgtttgataattgttgtaaattatatttgtttgagaaattttaattttataataattgtataatagtagaaagatttagatataaaaatatttattgtagtatggtttgtaatagtgaaaaattgaaaataatttatatatattttaataaggaaaggttaaaataatggtatattatgttattattatttgaaaatattgaaaagatgaaaagatgtttaataatatttgatgaataaaggttgaaaaatatatgtagtaaaattttatttttgtttttaaaaaatatatatgtatgtatgtatttatgtatagataaaaaggatttgaaaatatataataaattatagttaattatatttattttatggtattgtagaatattagaatttattttttttatttagttgtaattttgtaattgttaattaatttttttttattttttttttttttttgttttttttagtttttgatagttataattttattttttattttatataataaaagtttttaaagaggggaataatggggtgggggatttggaatatatataaaaatttaaaaataattataaatttgttgttattaaaatataaaaagaaaaaaatagttatatttgtaaaatgggattgtgtgaggaagtttttatttttatatatttttattttttgtatgtttggatttttataataagtatgtgttattttttagtattttttgaagttttttttttaaaggtataagtaatatttaaagttattttttatttttttaatgttgtttatataaagataatgattttttttggatggttttaattttttttttgtaagatttttttttatttgttatatttataatttataatttttttattttttattgttttttattttttttataaagtgagtttagttagtatttgtaggtttgttaagtattatttttaataagaaagattaatttgtaaagtaaatgtggaaatgtattaatatagtattaagtataaaatagttatttaataattgaattatttaatttttttttttttatattttattttttttttaattttagaaagaatttgaattgggttataataaagataaatttagatagatagataaagatattttataggtagaaataaaattgagtgattataaattaattataggaggttttgttagtttgatgaatagaaatatatgtgataaaattatagagaggtaaaatagaaaatgaaaattaggattaagaaaagggaaataaaaatatgttggatattatttaataattatttgttgatggtaattatagggatggaaaatttattaggtttatggagttaaaattaattagtaagtatttatagagtgtttattgtttttattattggttttggttttttgtttgtttagtgtagaggtttgagatatttgtgtgatatttagtttgttaagatagaaggagtaaaataagtagatagaggtttattgtagttgtttatatttattatattgttggaattatatttaagtgagataaatttttttagtggaagatgataaaattagtttaaaagttgtaaatattattttattatttaaaaaaggtttaattaagtggagatattatttttgtaaagtaattattaatttatttgtgtaatatttgaaattttaaagtataaatttatattttattaaaggtaggaagtgaaattaataaaatttgtaataattatatttaatttttagggttttttttattgttgataaatattttaagttatgtttatttttttaaaatgtaaaatatgatgtttatgttattgttaatattttgataaaaagttattgttatggatatttgggtttttttttgtatgtttagaaatttttttttttttatttaaatttaaaatttttaattatttggagaagtattttttttttttttttttttatttgtattttatttttaggtgttagtggtgggtatttgagttaggttttgtttattatagtatatatttttgatattttttggttatagttattggtttagggataagtatttgaattaattagattagtgaaattttttttaggaataattattaaaattatgggaaaagaattttttttattgaagttattaatttggtaggatgtgttaaatttaggtgttataggttattaggtggagaggtggagataatttttttagaaaataaaataaaataaaataggaaaatgaagttaagggataaaatttaagttttttggattttatttgagtttttgaatttagttatgttttttgaaattaaattttttttggattttttagtgaattaaaaaattttgtttttaatagtggggttttttataaatgtattaaaaaatgatttaatgaatgttgtttataagtttttattagaagtattatttttaagagaaaaaaaaaataaataatttgaagaaaattttttataatttaagttagttttgttaatttttaggaaattttttgtgattattatttttatatttatatttatttttttaattttaaatattagatgattttttgaagtttatgaagtgttttatgtatttaatatatttttgtaagtttgtattgttttataatgatttgtaattgtatttgtttttattttttttagagaagagattgttattattttgatatttttgtagttttatattggggtttaatatataatagttgttattttgttgaaggaattgtattttgttgaaggaatttttttttgttgaaggaatgaatggagagaatattaattaagaaagttttttttattaataaatattttttgattgattgaaattatgtttaaaatagttaattattagaagattaaagtaaataatatatttaaattgaatttttaaagtgttagttattggtagttgtatagttgagaattttttttttttttggttattagggttgaaagggtgggtgaatgtggagatatgatttttttttttgtaaaatatttattattttttaaattttataaaatgtaataattttttttgaaaaatgttaaaatttaaataaaaaaatttgtaatgtggaatatagattgtaggttataatggaggaagtagggaaagtggggaaaattgtggttgttagaagttttttgataattaataggtaagataatagggtggtttttggtagggtttttttttatggtatagtaaagaaaaataggaatgaagaagtgagaagtatgaaaggggatagtaatatatgtgtaatatagggtgatttagtgtgagagttttataattaaaattgttaaatgtgagaaaaaaaaatttattataaattgggataggtttaaggtatggagatgaataaataatttttttatgtgggtaaaaattaatgaaattattagatgagtagtttagtatgtgagttttagttgtaatatgttattggtatttggggtttttttttttttttttttttttgtattttgaggtaatttgatatttgattaataatttagtttaattttttttatttgatataaagatatttattttgaaattttagaattgttaatattttttattttttattataattttttttgattttttttttttggtatagttttttatgtatttattttatttaattaagtttgtttattttttattagaaggtttttttttagtataaaaagtttttggaagtttattttttttatagagttgttggatgattgttttgtttatttttggtttttaaaatattttttttgtttaattatagttttttagtttttttgttattgtaattaatataaattttgttatttttttttgggttaatgtgtttgtttttttattgttttttttgtttttttttttagtttttataatttatattttatattgtaagtagaatgagttttttaaatagtaaattagattatgtttattagtgtgttagtaaatgtttaatagtttttgaggggaatagagtatttatgtgttttataatttttatatatatgtattatataatttataaaaagtaagaaaaaatataatatttttaatagtaaattttatatggttatgtgatttttatagaattattttagtgatttttgtagaatatttgtgtttatagttaatttatagttaaaatttaaatatgtttggtaaaattagattataaataaatatttgattaatatttaattagtaaagaagttatttatggtattgaagttttaatatgaatgttggttgatatttttatattaatgagtgagataaaagtgaagtaataaaaatggatgttggaattaaatttgtttattaatgatagaagtgattttttttgttgataatagtttttaagtattagaaaaatatttttttaagtttttgtgtttataaattaaggtatttttaagtttaatttttattattaaaattttttttattttgttagtttagataattaataaaataaattaagttttggtttgttatgttttttaatttttatagtataggtattttattatggttgattttaaattattaaaataatatttttgaatgtagtgttaggaagggatatgttgtattatattattgtatggtatgtttttatatagaatagatagaaataattttaagaatatagataatagtaaaatggagtaaaataattaggtagtaaagtttttagtatttatttttgttgttaaaatatttgattgtgagtttataaataatttggtttttaataatgattgtgattaataattaatttataaaatttttgaaaatttaatagttagtgtttgtaagttggtataattgtttttggtgtattattgaattattatttttttgtttaaaattttagattgtttattgtattgattttttgggaaataagtgaaaagagataatgataatttttatttttgttgtggtgaagtgatagtgtaaaaattttataagtttttttaagttttttaaataaagtttagtgtttaaaaatgtttgaatatatgattttatgtaaggtttatattattttttgtgtgataggtggggtagatattattattttttttttatagattgaaaaataaggttgagaaaaattaaatgtttattttaggtttatttaagtaagtaaatggtagaatagggtttaaaaattaggttttgtattgaaaatttaataagaggatagagaaaatttaattgataaatattgattttaaaataattttttttttaatggtgataaatgttttttgtagtattttggagtttgatatgaagtatttttttattttgttaagggatttttatattaagaatgtttttattttaattttattatttttaagttagtttaaaaataaaataaaattttgtgtgttttaataagaagatataagaattaaaatggaaatgtaggtttttaaatgagttgaaagattttatatagtagtggggtagattgaaatattttttattaaaggaatatgggagagaaaaggagattaaattaagaaaggaagaaagttaatgatatatgaggagttataaatgttataaatgaaaaaataaagtatgtaatatttgttgtaattatttagtgtgtttgttttaatgtttttaaatattaaaaatattgagtttttgtttatggtaatatttattttatttatttgttgatagttgttttatttttgaattaggtattgtttaaattaagttttgttagtataaagaataaagttaattaggatatttattgggtattttatgtatatgagtataaattgtgatattttaggttgtttatgatgaaattattgaaagtattatgaaagatagtaaaatagtaggaaagttagtaataatttagtattttttagtttaggtgggaatgttaattttaattataatgaggaatattaaagtggagtttattatgattaagaatttgttgtattagtgtgaattgtttataataggtatgtttggtataaaatataaatattgaagtagatagagatggtttatttaaagtttagttgggtttttttgaattttttattttataaagttaaataggaatagaagtattttttaaagttaagatattattttaaagagataaataatagttatgatagttgtaggaataattttttaaagtaagttttaattattaataaaagttgtttgtgtgggtttaatatgtttaaaatatataatatatatgtatataatatatgtatatatggtttttatttatatttaatattatatatttaaagtgagagagtatagaaaaaaagaataaatggaaattgaagttatgataaagaattatggattataggaaaataagttataaagaagtatgtttatgtaagaggaaatatatgtgataaataataggagatatgggaatgaatgtggtgttttatgttttttttttaatagaattgtgtaatagatattatttaatattgattttaattgatttagttttttagtttttttggaaaataatggattgatgtttagggtgtgttgaatattggaattatggttatttttgtattttatatgattttgtttttattagttgagttattaatagtttttggtgtttttgttttttaaatatgtttatgttatttgttgtttattattgtatttatttaatttgattaaatattaagtaaaatgatgaaatgagtgtaaaaaattgttttataaaatttaaatggaaagatgttttatagttttttttgatttatagttgtgttaagtaaggtggatgtaagataattttaaaagattggtgtgggggtaggagtgaggaattataaaaatttagaaatttgtatgaaaattattttaaaagtatatattgaatatttttaatttgaaaatttgaattttgaagtgttttaaaatttaaaattttttgagtattgttatgatattataaatgaaaaattttatatggaagtatttattataaattttgttttatgttttaaattattttaaatattgtataaaattatttttaggttataaggtgtatatgaaataaaaaatgaattttttatttagatttgggttttatggttgagatattttattataatgtaaatattttaaaattagaaaaaaaaaaatttaaaatttaaaatatttttagtattaagtattttaggttatggatattgaatgtgtatttttaattttttgttttattttgtttaaaaaaaagggggaaaatagtaattttatagatgaataataattgttaatgatgagtaaatattttttatgatttaggaatttgtttaagtattttatatatattaaattggtttaatttttataaattagtattattattatttttattttatagatgatggaaaaaggtatagagagttagtttgtttaaggttatattttttttagtggtggagattgtatttggtttttatagtttggtttttaattgttatattatattaatgtattataggtatagtttatatatatattaaagaagatatggaattttagttagtgggtttataaaagttttagatttttattaaaagattagaaaataaatgtttaattataggttttaggttttaaaagttttaaaagtttaaagtttgtaagttattttttttaaaattattttttttttttaattaatttttaaattaaattttagtttaattatatttattagaaggttttattttttataaaggggtaggtaaaggtgatgattttaaatattatattgggagttgggatttgtgtagtattagaattaagagttattgtatatatttgagaaggagtatagtttgatttagttgatgttttggaggggtaatttggtagtatagtttggattattttagtgggaatggagatgataaaatatgaagagaatgggagaatttatttgggtaatatattagtttttgaaattaatgtattaagtggtttggttattagttaggtttaaggttttattggttttaggatatagtttttaagattatatattatttttatttatttatttaattaatatttattgagtattaattatgtattagtgatataggggtgaataaatagatatagtttttgtttttgtagaatttatgttttggtgggtgatatagagaaataataaatgagggtataaataatgaattattattgtaatgtgttaataaagtatgtagaatattataagaatatataattaagaatttaatttagtttattttaaaaaaaagtggggggagtatttagatgtttaaatataaaataataaaaatgaggattttgagggttatttgtatattttttattaatttatttggttataataataatttagtaaaagtgattttatatttagttaattagttgatttaatgttattataattttgtaatgtatttgttgggtgtttgttatgtagtgggttgtgttttaggagtgggatataaagttatgataagatagattaggtttttgttttgattgagtttgaatatattatttttatttttatttttgtttttaagataattaaatatttttttatttagatagggatttattttattttttgtagtaattataagtttttagggttatagattagtaaatgttatatttaaagatttaggatattgtgtataaaatatttttaatagtgtttgttagatagtagatgtgtaataaatgttgatttttgttagaattgtgttattattataatgttaaattttatgttttttttggtatattggagtttatttttttaattaaattttgtaagtatatattgtaagtagtttattagaattgatatattattttatgttaatgattgagattagtgaggaaaattattttaatattgtttaattttttttttaatgtataggagttatgtgaatttagataagtattaatttttgtaagtttgttgtttttatattgaaaaattgaataataatatttattttatttaattgttgttagtaaaagtgggtagtagaagagtggggattaataaatgttagttataaattataattatttgtattattttgaaaaagaggggttaatttatagtttatgtatgtttttaaatgaatgtgaaagattaaagaatgagaatttttttgttattaaattaaaaaattaataggtatatttagattgttgaagagagaaattaggataagtttttttttttttttgtttaattaaaaatgtttttaatggtatatttaaaattatgtatttttttttattaagatttgtagagaaaaaaaaatgaagggagaataattgggaatttttgtgaaattataaattatttaagtagagtatttattattaaggatttgagtatgtatgagtgatgaggtggatttttagagtagagatttagtagtgagataggttaatggtatggggagatgtgttttattagataattgtattgtttttttaattatatatatatatatgtatataatatatatgtgtatatatatgtatatatatatgtatatataaatagaatttttaattattttaagtagtgtataaggataattattagtatgggttatttaatttatttttaaaatgtgtaaaatattattgtagggttgggttttgatttgttttttatgaaattgttggtagtttaggggttaaattaatgaaagatattttattttagtgtttgaggtttagaaattggaaaaatgggtaattaggttaagtagtgtttttatagttttatagatgagtatttaaagtaagggtttttttttagttgatttgtgttaagggataggagaagtggagtttgttttttgggtttagaagggggttttgttaatatggagttgtttagtgttttttataaaaatttttttggttgagggttttatgttggtatatggttggttttttttttttttttgaggtggtgagtatttttttttttgttaagatggtggttttagaattttttggaggtggtttttgtagattgtttttggataagaggtttgttgaaagtttatttttttttttttatattagataatgtatagggaattgtttatttttgagaattaaggaaggatggtttaggttatttgtgattgtgaatttttgttaagatggtggttgtggggatgggttggtgatattgtattttattaagatggtggtgggtggtttttgggatgtgtttttttaattgtttttaagatgttagagtagggggagttgttgttagtttgagtgtggtgggaggtgagagagtggttgtggttgagtgtttgagtaggattaggtggagttgtggtagtttttgtttgtgttaggagttggtaagtgatgttatttgtgggggtgtaaaagttatttttttaaattttaaatttatatagtataattttttttagagttataaaaattataatttgtgttgtataaggtaggaggtttggttttggtattgtttaagtttttttgatgtggtgagttggggaagggagttggggtgggggttttttgtatgggtattttttgttttatggttttttttttttttaggatggattatgagtttttttttttttggattgagggggaagtttttaataggaatatttgtagggagttgaatgttggtattttaaagttgtttgtattttgttttatttgtaggggtaggggttttatgaatgtgatagggtgagtaatgtatagagttgagggtagtaaatgttaagatttgggggtggggtttgtattgggaatttggatgtgggttttggttggggtggaagaagaggttaggagttttggaaggggggttatattttgttagtaatttattattttgtttgtaatttgtttttaagtttgttgttttttgttttttttaattataataataaaaaaaaagtgtaaagaaatttagtttgttggaggttttgtatttggtgtgtaattttttttgagtgtgagtatattgggtgggaggggtgggggttgaatttggtaggtggtgtttttttttgttgttgttgttgttttgtagatttggggaagagggtgggggatggttggggtgtgggggagggtgggttttgttttgtaattttttttttagtgtgagagtgtggtggtggtagttgaagatttggttgtttagatgatgtggtggtgggggatttgttggtatgtgattttttttgggtttaaagtatgtatgtgttgatttttgttattttgttttttttttgaagtttttttagagggtgtgttaggttgtttggttttgagtgtggttgagatgttgtggtattgtttttgtgtaattttgtagttttttttgaagtgatatattttatgtaatttggtttggtggtggtggtgtgggttatttatgtagtttagttgtgggaggtgttttggtttttgtggtttgtttgttgttatttgtaggggtattggtggtgtttgttgttaaggggtagagtgagtttttgagtgggtttggagttgtggagttgggtgggggtgggaaggaggtagtgagaaaagaaattggagaaatttggtggtttttttaatgttgttttagagagattaggttggtttttgttgttgttgttgttatttttttttttggggagttgggggtggggggtgaagtgtggtgtattgggtggggtggttatgttaggggatgtgggtgtgtaggtgttgttggggttggggtggtggggtttgtgtggagggtgtgggggtagggattgtgggtgtttttgtagttgttaagtgttattaataggttgtattgttttttgtggttgttgtgtggttttttgggtggggagtggttgggggtggagtgggagtgtgtgtgtgtgagtgtgtgtgtgttgtggtgttgtttttatttgttttttgtttggttttgtttgtttgtttaggttgggttgtttttttgtgtgtttgtgtttttttttttttgttgttgttttttttattttgtgagtttgtgtttgtgatgggagtttgagttattgtttgtttgttggggatggattttgtgggtggaaggagatgttgtagttggagtggttgaagtagttgggattgggatggggtatgtgtgtttggaattttgatttgtggagtttggtgtggggtggagggttggtttgttagttgggtaatgggagatttttttaaataggggttttttttttatttatggagaaaggggtggttgtttattttttttttttagaaaaaaaaaatatattttttttttgttttttttgtgtttataagttaagttgtttattttggttgtggtgggaattgtggatggtggtgggtgagtggtttttttgttagaggtaagaagtgaggtgggagggggttggggtgtgtttgtttttttgaggtgttgttgggattggagataatttgggggttgttgtgggagtttataaatttttattagttttggggagtgggggtggggggttggtaagggttgggtgatggtgatgaaagggtagtgtgtgggtgatagtgttggtttttttttttttttttgtaggtgttttttggttgggttgagggggaggaatttgattttggatggtgagtggagttttgttgaattgttgggggttttgagttttttattttttgtgggaattttggttttttttttttttttagtgttttttttttttttaagggggttgtttgatatttgtttttgtggtgaatgttaagttgtgtttgaattttatttgtttgaatatttgtatgttattttggtgtgtttgagtgtgagtttgggttttggggaggttttggtggtgtttggtttgaggagggtgtgtggggtgtgtgagggtgtatatgtggggggttgatagtttgtaatttggagattgtggttggggttggtgttatttgttagaagtgggtgtgttggagagagaatttaataggtttggatgtattttttttttaattttgtattttttttttttttttatttttgttttgtaagggtttgttttttagtgtttgttgttaatttgtgtttgaggtttttaagtggttttttttagaaaaagattttttgtaattgtaatggttttgtgttgtgatttttataagtgttagtttgatgtttggggttgtagatttgataattgtaattttgtaatattatttaagattttttggtatggtttattagggttaattaatgtggttgggttatttgtaatttaaattgggggataatgttgtttgagggagtgtttttgttttaggaaatattgttttggttttgggtttgaaggtagttgttaaaaaagtggtatggaaatttattgggttttatttgatattttgtgtttagagattgttattgttttagataaatggggtagagaggtggggagataagtagtttatttttaagatttgtagtggtaagtttatatttttttttttatttttatatttattttttagtgagggttagtgatatttatgttgtttaatgttattgtataggaaaagttattttttattggatgggatttgattatagtgttttaaatgtgtttttttgttttagtttattttttaaaatattttgattaatgatatattaatagttttatttttttgagaataggttgagaattgggataggtgaaggtttggataggtgaaggtagagaaaattattttgaatattttattggatatagttgtatttgaatttatatgaatgtgattttatggttttgtgtttttttattttttagtattttgatatttgtttggaaaggaaagaatttagagatgtaatagtattttatattgaggattttaagtaatgtaaataaatgtagtttaatttagatgtttttgtgagttatgataagggttagttatatttaagttatgtaagttaataatgtagtgagaaattattatatttttttttttgttttttaaaatttaaattttagttggtttatataaagtgtattttattttatatatttaaaatttggaggtaggtatatttagttagaagtatgggttaaaaagtttttttttagtttgttggaagataagtagattagtattgtttattttttaaagaaaatgtgtatggtttattagttggttgtatttaaaggtttggatgtgtgattagttggtaggagggaaatttggaagtaattagggattgagaattttagtatagtatttattaaatgttatatgtattggtttttagaaaagtaaatagttgtgattgaaaagaggtaggaattttaatgattatattttttttttttgaaattaaatattttgatattaatttgaatttttagaataattagatgtaatgaattataatgtttgtgattaataaagttatatgtttagtgagtggtaggatgaatagttaagtttagtttgatatatttttgtttttagttgtgtaaatggattgtattgtatttttaaatgtggtatgttgaatgggagtaggggatatggttttttattttggaagatagaaattatttttttggtaataaagaatttgatttggagttaattaaaaggtttatttaataagttgttttttattaattggattaggaagataatgtgattttagagtttatgatgttttttttttgtttttgttttttgttttgtagttgatatttattgatggattttaaagaattattaatttttggtagagaagaaaattttagtagtgtgtttgtttaggagaggggagatgtgatggatttttataaaattttaagaggaggagttattgtgaaggtttttgtgtttttatttttattggttgttgttttttaattagattttaagtagtgaagatttttggttgattttttaaaaggtttagtaagtaatgtgtagtagttagatttgtttaaagtagttttatttttaatgggattgtatatgggagagatagaaataaaagtgatgggaaatgatttgggatttttatagtagggttaaattagtttttttttgggggaaatagatttaaagtttttggaagaaagtattgtaaattttaataggttgattagtgttttagagaattttaagagtttagtatttattgttgtgtttgttgtttttatagagaaggagtttttaaaaatttattttgatgtatttttagaatagtaatatttgaagggttagattggtattaatggtggtaatgtgaaattgtatattatagattaaagtatttttgatattttgtaggatttggagtttttttttgggtttttaggtaaagagatgaatgagagtttttggagattagatttgttgatagatgaaaattgtttgtttttttttttggtgggagaagatgatttattttttttggaaggaaatttgaatgaggattgtaagttttttattttattggatattaaatttaaaattaaggataatggagatttggttttgttaagttttagtaatgtaatattgttttaagtgaaaatagaaaaagaagattttattgaattttgtatttttggggtaattaagtaagagaaattgggtatagtttattgttaggtaagtttttttggagtaaatataattggtaataaaatgtttgttatttttgtttatggtgtgagtatttttggaggatagatgtattattatgatatgaatatagtattttttttttaatagtaggattagaagtttatttttaatgttattttattaatttttgttggttttgaaaattggaataggtgttaaggatttggagatgataatttgatttttttggggattttgaatttttttggttgaatagttttttttaatggttatttaaggtaagattagtgtttttttgttttttaagaatggtatatttaaggtagattaatagatgtaaatttttattgatttatatgtgttttttaaagatttatgtgtttttttatatgaataagtttaagtggttttttgaaagtaggaaaggtagataatttaagtgatatttgtatgtaattattttaggttttttttttaaatagtggtttttagtattttattggttaatggtgaggattttatttaatatttttaaaataatgttgtttattaatagatattttaatgaaaaattatataaatttaggagagtataatgttttataatattatattgtgttgtgtatggttatttagttgttttagaatatgtttttatattataataaatgatatttttatttatatagttaaaagttgtgttgttttatttgtaaatttgttaagtgttagtttgagattaaagagttaaaagtagaagtattaataaagagttttattttttaaattgaattttttgttaaagaatttgagttttgaagttgttaaagtaatgtagtgaatagtgtattagattatagtattagatataggttttgtttatagggtttttgttataaagtagataagttatgtttgttgattaatttttttaagagaggaattggtgttaatatggtgtaaaataaaattttatgtttaaatgtttttgtaagtttttaagtagataattgatggttaaaattgttaagttttaatttttagtttttgtttgattttttttttttttttatttagttgtttataagtatattgatatttttgtttgatttaaaaaggttagaaaatggaattattagaaaaaagttttaaatgtagatatatgtgttggtaggggtgaatttttttattttgtaattttatttttaatttagataaatgttaggttttatatttattttagttgtgaaggaaaatataaaaatgtggattgtagtgatataagattgattaattagtgggtttttttaaaagaagatatggtagatagtgatttatttgtatgtaattattgaagtttttttttaaatgttagtgatatttattgtttttattaattagttatttagatttttgaaaattttttttttgtgaaagttattttaatttggaggatgtttttttttttttttttgtatttaagaagttttttttgttagggaaataatttagaattagatttaggttatgttttgtttttttaaaaggtttagttgttaaaaaaaaaaaaaaaaaaattaaaaaattttggtttttatatgttttaatgtgaattattttttaatttattgtttaaataattattttttatttagaagaatattattttaatttgagttgaaggtttaaaatttttttagtaaggagatttgagatttttattattgtataagttgttgtgttttaaatgttaaaagatatgttgtgttttaaaatttttaattgtaaatttttggtaatagaatttgtatatttggtttttttaaaagagttaagtatggttgatttgattaagttatttgtaggaaatttttaaattgatttataaaatatgtaattatataaagaaaaataaaatattttaggaaatttttggggattattaatggattttgttttgataattattatggtatggtttttattttttttattataaagaaaaggtaagggataaaatttattttttatttgttatgaatttttaaattttataaaatttgggatatagagtataagtagatgaatatagttatttttaaattattaaaggtgattttaatgttttaatttttatagtattttatgatataaagtatttttatgtatttttaatttgggttttataattttatggaggtagtaggtaaggtaatgatgatgtggttttttagaagttttttaatattaaatgaaattattatttttatgttaatttgtgattgggaaatataattagtagtttgtgttttaataagaaggtataatattttatatagggtattttgttaatatttgaagattttatattttatggtattaatttagtattgggaattatgattatttaaaataaagttttatttaaataaattgaaatagtgttttttttaaattattattgaattagtttattgtttttaaataatagttttgatatagttaaaattagttgtttttttttttttatatgttatatgattgtagttaaatatttgttatgattagtgattttgagtgattagtaaataattaatatattgagattataatttgaatattgattttttgattttatgaagaaaaatattaaatgttattaataatttgaattttttttaaattaaaaaaagttataaattgtaatttgattttttaaaatgttatttaaaattgtttttattagaatatttaaaaaaaaatttttattttattttttgggggtgggaagaggtaattttttttttttattataatattgaattattatataaaattgtaaaattatgaatattatgattgagtttagtaaagtattttttaagtttatttatagtaaaataagagaaattttatttttaaaatttattttttaagtaaaataaattagttattttaatttaatatgtttttaaaaatattgaagtttagtatatttagtataaatttattgatgaaggtatatttttgtattatttgatttttagttttgttttatttaagtattaatgatagaggtagagaatagaaatggttttaggtggtattagagtttttattgggattatgttgaaattttagtgttaaaaaattgtttgtattttgaagggagggattattggagagaatgaatgatgtaggatgaatttgtaaatttagtttttggtagagtttaaaattaagtgatgattggtatttaatgaagttattaaaatttatgtagattttaatgttttattagtaattgtatttgtatttggttttataaaagtaatgaaattgaagatttgtataaatatagaatgaatgaagtaaattttgttaatattatgttgaatgtttttttagaaaaagaggaaatatgaagagaagagatttgttttgattgtgatttatttttatttttatggatattttttttattttttatttttttttttttttttttttttttaaagattttggtaatgggtgttttagtgttttttaagtttaatatttttggtatttatttatgtaaagtgatttttgaatgttaaaggagatttttttttaaatatatttttatttatttttagttttatgatgagaattttattttttaaatttgtaatttgttatggttatatgattagtaaaaaaagtttttaaaatatattgtgtatttaggtgtgttattttagtgtgaaatgattaatgtagaaatatgtgattagtatgtggttagattttattgaaattatttatgatgtttttatggttagtttttttgtatttttataattggtaatataatttatatgttattttggttttgtttatttgtgttatatgtattttagtttgattatttttgttatttatttaatgtttatatattttatgaaagatttattttgaaatatattttgtataaatgtaggttaaatgtaaattgtattaatagtgaaatggatatgtgggtagagattattttaggggttttttgagatttagtgaaggaaagattggattaaaagggtttattttaatgtgattgtttaatgtgaaagttggaatatttgtattaattggttagttatataaattttagtttattttggtttgtaggtgattgaaatagtttaggaaattttaatttatattaagtttagataaggtttgaggtttaggtttagtttttaaagtatatttttttttattttaatgattatttttaattttaatgagtagtgggtttttattgtgtattagtatttaggtgggtaaattaaataagtaaaataggtttgtgttgaatagtatttatttttttgaggatattttggtaatatttttattaagagtaattgtgtaatgtaatatttataggtatttgttagattaatgggtatttgtttttatatttttgagttatggaaaatatatattgatgatttttgttgtataaagagtttttaagaaaattttgttgaattaagttataattataaaaaaaaatttattatatattgatttttagaaaggatttttaaaagtttatgttgtttttatttttgtagttttagagagttgattgtttttatttttttttggtatattttattaatatttgggttttgtattttttaagtaaataaaatatttttattgagaattttaattttaaaaaagaaaaggtttattaagtgtttttttttttgttgaattatgtgtgattatttttatgttaaattagattagggtgtgatttgtgatggtgatttttgtttattttatatattaagaaagaaatagaattttattgtagtttaaaattatttgtagatagtggttttaatttttagatatttaattgtgataggttgttttttttagtgtttaatattgttgtaaatgtttttaaatatagaatttttagtggagtttatgaattaattgggggtggagggtgaagagggaggagtaatagagatgtgggatgttatagataagtttaggaatatttagattagttttgaaaattaatagtttggattaattgttatgaattagaggtttaagaaaagaaaaatttaggattataggtataagggaatgtattaattagaattataatttaattttttttattttaggtagaaatttaaaattgattatggttatataatattaatttttgagttatgttgttttttattatgttttattattaaaaaaggataaaatgtatattttatttgaagattattttagttaagattaagtttatattttttttatttttatttaagttgttgtttaataaatgaaaatttaatgatttgaatgtagttgatttaatgttttaatgttgatataattattttatatattatagtgtttttttatagttattgttaattgattggagagtaatttttttttttggtaatatatttttatgggttatgtatttttttgttggaatattgagaaaattaattttttataatatgtagaataaattatggggttttgtaagtgttagatagttatttaaattatttatattgtaatatattttttaaatttagtattttgaatgaaagtgtgttatttttgaattttattatttgtttaatttaaatattaattatattttaatagagttgtatgtttaaatatgtttttttagagtaatttaagtattaattttgagtgtttttaaatattttttttttttagtaagttttaataatattaattttgtttataatgtagtaagtttagtgaaagtatttgttgttttataattttttttttatttttattgtagggtattaaaaatatatataaggggaaaaaagttttaatgatatgattagttgtaaatgtttatgtattattttattttgaatttttatttttgtaattaataatttgagagtttaataagtatgtagtgtttaagatatagtttgttgtaaaaagtgttaatttattatttttttttataataaaattagtttttattttagttgattttataattgtttataatatttagttgtggttattatgaaagtatatttgatagttaaattttgaaagttattatgaaatgatataatttattatatgatttattattttatgttggttggggtagtgttgtgatttatgattttatgattgttatatgttgaatattaaagttttattagtttgttatggatattgttttattttatgttattgttttaatgtttttttttataattattgaggataagagtttttttaattttaagattatttaaattgtagattttgtttttttatttttttaattattttttttaaagaatttgatttagatatttagtagtagaaatagaagaaaaatatttaattaaaagtttaaagatttagtttttaatgttaagggagatagtttatggtttttaattaggtattttggagttaaaaatattttttttataattgtgtttgaattgtttttaaaatatttgtgtgtgtgtttttaaaattttataatttttttaatttgttaatttgatgagggaagtaattagggtagggaatggtataataaagttggttttttgatattttttttatagattattgaatgtaagataaatagatgtgaatgtagatttggtgtttttataagataaggatttaaaataatgtagttggtgatatataaaaataaattattgttgttgttagtatttgagaggtggggtttttgggtttttagagtttgttttttatgtttgttatagttattttagattagaatttaaaagaatttgagagtttttttaattttattttttaatttttttgaatgagaaattgagatttatagaaagtgttgaggtaaagattataaaatatttaatgagtggtgttgttagtttgaatattttaatttttagttatttaagttttttggtaggtttttttaattatttgggttttttttagatatttggaataaatagttgattgatataatatagattagttatatattttataagagttatttttgatttatttagatttttaaaatatatagtgtttgtatttttttttatttattttgttaatttttttttatttaataatgattaagtattaattatgtgatagtattatgttaagtattttgtatgtatttattttatttaaattttaattttgtgaaagtttttattttagttattgtattaagttttaattttgttaatatttatgaagtatagaaggtagttgttatttattttaattttatagatgtgaaaattaaaggtatttaaagagaaaaagaaaaaaaaaattaggaaattttaatatttatttgaagggaaatatttaatattgggtatgttagttttttatgtatttttaataatttttgttaatagtgaatttttaaataaaatataaaggattaggtttttgtttttttgtatatatttgtaaagttatttattgttttttgttatagttttaatttttgtaaaatagtgagagggtttttatttgataggatttgtgtatgtatgtttattttgaaaattaaaaagtattaggttaggtgtggtggtttatgtttgtaattttagtattttgggaggttgaggtgggtagattatgaggttaggagattgagattattttggttaatatggtgaaattttgtttttattaaaaatatagaaaattagttgggtatggtggttggtgtttgtagttttagttatttgggagtttgaggtaggagaatggtgtgaatttgggaggtggagtttgtagtgagttgaggttgtattattgtattttagtttgggtgatagagtgagtttttgttttaaaaaaaagaaaaaaaaaagaaaagaaaattaaaaagtattataaaaatgtaaggtggaatttttaaagttttgttaagtttatttagtttaaattagtatgatttttattggttaagtatgttatgatatttgtgattgtggtgtaggtattgtttataattaagaattttttagggtttgttatgtgtaatttttgaagggttatggattgtagttttataaagattgttgtattttaaagtttttaaatgttaatgtagtatttttataatgatttttttttttagttttattattttttgaaagtgtttttgataaagtttttagtggattttgttgagggatattaagtatgttatttatataatagttatagtgataattttaattatattgttatatttttattaataaatgttagagtattttttttttggtattttttattttgatatttttatataattaagtatgtaaagattttttgttattggaaattttaatttgtttgaaaatgggaatgaaatttttaggtttaaaatttttttatatttattatatttattgaagttgtttgaaaaagtttttgagtatattgaatattaaaatttattttaattgtataaagttgggaggattgtgaaatttgattgtattgatttgttttttttattgattaaatggttgaaaaaaattttagttaaataaatttgatttattaaattaaagttataaaagtagaggaaagtatagaattattaaatggtagtttaaattggtaaatatattgatgtagaatttaagtttgtaggtagtttttttagatggaaatttaaaaaaattttaattagaatattatgtgaaatttgttatttggaatttagttgggtttattaaggataaagtgtatggttataaaatagattgagttttttttttaaaatagaaaatttaaaataaatgttttaagtttttattttaggaggttatgtatattgtttttttttgaaattgtttttagaattattttgtaagttataaaagaaaattggatttattgtattatagtaatatttaattgtttttgtttaaagaaaatgtatttattttttagttttatttgtgtgattttaaattatatgagtattgttagatatttagaaatttaatttttttttgaatgataatatttattttttttgagggtttttaaaagagtttatatagatatttttatagaaaatgtttaattttgttttgaatatgtttggaataagtgaatagttttttagggtgattattttgaaatgggtgatgtttagtggttaagttttgatttgtgtttttttgaagttattaaggaattttatgataatagtttatatattttttttttttggtatagtaatgaagtaatagagattatttatttttaagtttgattttttaaataagtgtttattttatgtttaagtaaggtaggtttgtttttggtttggatttgaatttggtaatagtagatataaagtaaatataatgtgaatttttataatagttttttaaatagtttaattttttatttatatatattttttttagtgtattagggaattaagtatttgattattagtatagtaagaataatttaagtatattgaagttatttatatttataaaatagtttgagttatagttataatataaaattaatatatttttgatttttattttttataatttgaaaaaaatttttgtgattattgatagtatttttaaaaattaaatgaattttgttattattatttgttaaatttagttatgtttattgtttaaaaaatgttaggttaaaatggattttaatttttgaaatgatgaagatatgtgtagtggtgttaaaaataggatatttattttgtaattattttgttagtgttgaagtttttagaatttttttgtgataatagtttgtttaagaattttagattttttagaattgtattaaaagtaaattgtttttttggatatttgttttttttttttaaaagatgatttataagtttttagagttaagaaatgggaaggaagagttattttagtatggtaggtaatgttttattgttaataggttttttttgtattgttttatttgttttgaattttttattttgttttgttagttgggaggttggtagattttttattaggtagtaaatgttttttattattaaatatatattatgggttggtgttagtgtagtttgtggatgggtattatatttttaattaagaaatgtttttaaaggaaagataaattggtgaagtaatttttaatttagtattttagggatgagtgattttttaattgataatgatatttaatagagttgtatagtgttttgggggttttatagatatgtttaaataagaaaatagtaaataaggaagttagaaggaaaagttataaaattattaagaaagaaaatgaaaattttaaattttaattttggtgtttggttaaatttgatttttgtatgttttagtgtttttttatggatattgggaaattaataagtaatttagttatgttattatgtttgtaagtggaagaattaaagaattataaagatatgttttaggttaagaattttggtggtaggtagagtgggaggttaattagatgatttttaaggtttttttaattgtatttggtagtagtaagtatttattaagttagatattgggtatatggagatgaagaagatgaatatttttagtagtatggagagtattttgatgatagttatttttgttttttttttttttagtttgttttttgaaatgtgagtttgaaagattttaaatttttttttgggaagatataattgaaattttatggaggaaagtgtatgaatgaatgggaaataagatttgatttaattatttggaataagaaaaggggtaataaggagtttgaaataaatgaaagaaaagatggaaagaattagttgattagatgaggattgagtatataggaatgagttaataggagattttagtaattaatggatgaaagtattatgtgtatgtatgttgttattaaatattatatgatataagataaggagaaaatatgatttttattataattttagtttgtgtattttagttgtaagatattttttttttttagttatttaagaatatttttattgtttaggagaaataattttttttttgggttttttagtgtataagtttaaatttgaggaaaatttatttgaaatgttttttttttagatatttatatggtttatttttttatttaaatgttagttttgtaaaagagatttttgattgttttatttgaaatagtagaattttttatagtttttttttttttttgatattatttatttgtgttttatttgtttatttgttataatgtaagttttatgagagtagtgatattgtttgttttgtttatttttgtatgttagtgtttagaatagtgtttagtatatagtaagatttttataaatatatgttgaatatttaaataaataaaatttaatatataaattaaaaagatatataggaatggattatatttttaattttttttgagtgaggaaaatgttagtagatagtgaatattattgagagagagatgatagtttaggttattttttttagatagaaataagttttaagattgataggtgtatatgaatatagagagtatatataaagaagatgtatttttaattgatagtttttaaatttgttttaagattttgaaatggattgttttttataattttttagaataattttggtttgtttattattgaaaaattagagtagttaatgtttgtaaatgaagggttagagggtttttttttttggtggtttgttaaaagtttgtttaaggtagtaatatagtaaattgttaatataggaatttttgtagtagaagttttatgttttttatttttataagaattgagattatttaagtagatgagtttaatgtatatgtttgtattgatttatttagaaggttaggtaagaaattggtttttttattttttagataagtgtgtgtgtaattattgagtattttaagagaggaggggtgttttatttttgtttgaatttttaaaatatttttttttagtttatttatattttagatttgatttattttgtttatagtatataatagttaggaggttggtaggataagtttattttttttattaagagttataggagagtttaatttaatatggtaatgatagttgtagaaaagagaaaatgtaagttaagtaggtgttagttatagtaagaaaattagatgaggttatttaagaatgaattgttttaatgtttaggaaaaaagaggggagggataaggatagggttttagaaggtaattaaagagagtagttataaaataaatgaatagttgaagaattaggagataataattttaaaatgtggtagggagagggtagttgttatattaattagtatagaagagatagaatagaataatataaatatatgagtgattattgtttttgaaattagtttttaaaatatgggaatatttttaaaaattaaagttagataaattagggaaattttaaatggtataatataattagtgattttgtttataatttttttaaaaaggagatttaaatttgaaatttagatgtaattaaagtagataataagaaatatatttttgagattataaagattttgagatttagttaagagtaaggtagaaaggttggaagttagaagggaattaagtttttgttttttgagaagttaatataataggaaaaaattggttatattttagtttaaatttttattatttttattaatagttttttaattgtttttttagtttttttttttttttttttaatttattttgtagtttattgttagattaatttttttagaatattatttttagtattatttttttgattaaaaaatgtttgtggttttgttgtttatagtatagtggttttttttttttgtattatagtttatatgtatgatgatagatggtgggtagttatatgaattttttataatttttggaggatttgggttatatatagtttgttatttaagaaagtatatttgagtgtaagtgagtattatagggatagttttataattgattttttttaaaatttgtttttttttttgtaaatgtttttttagaatttatagaaatagtgtgtttattttattagtaaaattatattttaaaatgttaataagtttatttttattatgtttttttttttattttttttttttttttttttttttgtatatttttttttattttttatatttttttgtaattatataagtataaatagatatatatgagattttttgggttgtttgtttttaaataaaagaatgggattattttatatttttttgtttgtagtttgttttttttatttaataagtatattttgaatatttttttaggttaatagatgtggattttatttttttaaatagataatattttatttatgtggttttgtgatttttgttattataagtaagtttttaataaatatttttttttatgtattttttataaatagtaattttttttttaaatataaatgttatggtttggttttgtatttttatttaaattttattttgaattataatttttatatattaggggaggggtttggtgaaaggtgattgaattttggaggtagattttttttttgttgtttttatgatagtgagtttttatgagatttggttgtttgaaaatgtatggtatttttttttttatttattgttttttttgttttgttatgtgaaaatatggtttttttgttttttattgtgagtgtaagttttttgaggttttttagtaatgttttttgttaagtttgtggaattatgagttagttgaattttttttttttgtaagttatttagttttagttagttttttatagtattgtgaaaatggattagtatagaaatttggtattaggatagtggggtattgttataaagatatatgaaaatgtggaagtaattttgtaattggataatgggtagaggttgtaatagtttggaggatttagaagaagataggaagatgagggaatgtttggaattttttagagatatgttgaatggttttgattaaaatgttgatagttatatggataataaagtttaggttgaggtggttttaggtggagatgaggtatttattgggaattggagtaaagtttatttttgttttgttttagtaaatagattgatagtattttgtttttgttttagagatttgtggatttttgaatttgagagagatgatttagagtttgtggtagaagaaatttttaagtagtaaagtatttaatatgtggtttggttgtttttaataatatatagttatatgtgtttataaagagatggtttgaagttggaatttaggtttaaaagagaagtagagtataaaagtttggaaaatttgtagtttgattttgtggtagaaaagaaaaatttattttttggggagtaatttaagtgagttgtagaaatatgtatagatgaagagtagtttaatgttaatagttagtagaatagggaaaatgtttttagggtatgttagagatttttatggtagttttttttattataggtttggaggtttaggaggaaaaaatggttttgtgggttaggtttagggttgtgttgttttttgtagttttaggatatggtgttttgtattttagttgttttagttttagttgtggttaaaaggggttaggagataattttgggttgttgttttagagggggtaagttttaaattttggtagtttttatgtggtgttgggtttatgggtgtgtagaaggtaagagttgaggtttgaaagtttttgttttgattttaggatgtatggaaatgtttggatgtttatgtattttgtaggggtagagtttttatggagattttttgttagggtagtgtagaggagatatatggggttagagtttttatatagagattttattggggtattgtttagtggagttgtgagaagagggatattattttttagattttagagtggtagatttattgatagtttttattatgtgtttggaaaagttgtaggtatttaatgttagtttgtgaaagtagttgtagggtttgtatttagtagagttattagggtagagttgtttaaggttttgggagtttattttttgtgttagtgtggtttggatatgagatgtggagttaaaggagattattttggatttttaagatttaatgattgttttgtaggtttttggatatgtatggggtttgtagtttttttgttttaattaatttttttagtttggaatgggggaatttatttaatgtttgtattttaatttttttttggaagtaattagtttttgattttatagttttataagtagagtggatttgttttgatttaagaagattttgtatttggatttttgagttaatgttggaaggagttaagatttttggggattattgagaatgtaagattgtgttttgaaatgtaagaatatgagatttaggaggggttgggggtagaataatatggtttggttgtgtgtttttatttaaattttaattatttgtaatttttatatgttaggggaggggtttagtgggaggtgattgaattataagggtggattttttttttgttgtttttatgattgtgagtttttatgagatttggttgtttgaaagtgtgtggtattttttttttttttttttgtttttttttttgttatgtgaatatgtgtttgttttttttttaatttttattaggattttaagttttttgaggttttttagttatgttttttttgaagtttgtggaattgtaagttaattaagtttttgttttttataaattatttagatataggtagttttttattgtagtgtgaaaatggaataatataatagatttttttaaagttgggtttttgagttaggggtatgtgtatttaaaattttaatagatatttttaaattattttttttgaggattatggtaagttatagttttttttggtagtgtttatatttttttttataataaaaatatataaattattattattaataaattttttgttatgagttttaaattgataataatatattagtgtgttatataatatagttgaggattgttgtagtttagaatttaggttttttttttttgtttttaataatatgtgtaatgtttaagattaatttagtgttatttattttgtatgtttttttttatgtagtttaggttatagttttttattttatttgatggtattttttggtagttatagattatatagttttttttatttaaattagttattagtatatagtaggtatttagtaaatgtttgttgaattaatattgtttatatatttttaatttatttttaagtaaatttagtttttttaaggataaggaatgtttttattataatatttagtatttaaggtatttaatttaggtagggttgtttgaataaagaattatagaggaagtaaatagtatggttttgtttttaatatatatattttatttttttttagggaaaattggaattgtaagaatttagtaataataataagaatagtatttttattgagtagttattatatgtgaggtatagtttaaattgtagaggatataatagtggataaagttttagttgtttttgtttttttgaagtttatggtttatgggtgttatatttaagatatttgtaggatatattttaaaatgttatttaattttaggttttttttagtagaaattgtggaatatttttttgtttatttagtatttatttagtgtttgttttgttaggaattgaagagaaagtttaaagataggtagattttatttgagaggtagtgaattgattaggatgattgtgggtagtagatttgttttttaaattagttttattatttttgtatttgtatatatgaggaaaggattagatatagggatttatgttagtatatattttagggatatttgtttttagtgaaaggtgttagtttttatttttgtatttagtatataaattatgaagaagtatgtttttgttattgttaaagaattatagaattttaaatggagttagttttgatatttagattttattttatatgaggaaattaggtttagtattgtgagtaagaattaggattttttagattttttgggtatgaatttgattaataattgtgtgaatttgattaaatttataattttgtaaattttgtttttttatttttaaaatgggtataataaagtgatgtatgtaaattgtatagtatagtgtttggtatttaaaaagtatttttgaagttatttttagtgatgtgttttaagattagataattttttaatgttaaaggtttttatttgagaattttgtttgttgtgttatattatatgttgtttataagataagttttttttattaattgattttaaattggttttattatgattttaattttattttagttttatttttaaaatttatttttaatttttatgggtatatagtaggtatatatatttatggggtataggttatgttttaatgtaagtatgtaattgtgggggtgatatataattgattggggtgagatattttattgtagttttgatttgtatttttttgatgattaaggatgttgaatatttttttatatatttgttggttatttgtatgttttttgagaaatgtttatttagattttttgtttattttttaagttggattgtttgatttttttttgttgtttgaattttttatatattttagttattaatttttttttagatgggtagtttgtaaatatttttttttattttgtgggttgtttttttgttgtttttgttgttgtgtagaagttttttagtttgatgtgattttatttgtttatttttgtattggttgtttgtgtatttgaggtattattaaagaaatttttgtttatattagtgttttggagagttttttaaatgtttttttttagtattttagttttaggttttagatttagggttttagtttatttttatttgatttttatatgtggtgagagataggggtttagttttattttgtttatggatatttagtttttttagtattatttattgaagagattgttttttttttagtgtatgtttttggtatttttgttgaaaatgagtttattgtaggtgtatgaatttgtttttgggttttttaggtttgtgtatttgtttttatgttagaattatgttgtttgggttattatagttttgtagtataatttgaagttagataatgtaatttttttagttttattttttttgtttaggatggttttggttattttggggtttttgtggttttatataaattttatgattttttttttttatttttgtgaagaatgttattgatatttattaataaagattgtattgaatttgtagattgttttgggtagtatggatattttaataatattgatttttttaatttatgagtatggattatttttttttttttgtgtgttttttttaatatttttttttagtgttttattgtttttattgtagagtttttttattttttttgttgagtttatttttaggtgttttattttatttgtagttattgtaaatgagattattttttgattttttttttagattgttttttgttggtatttagaaatgttatagatttttgtatgttgattttgtattttgtaattgtattgaatttatttgttttaatatttttttggtggagtttttaggtttttttaataagattatatagtttgtaaataagaataatttgattttttttattttattttggattttttttatattttttttttgtttgattattttaggtaggttttttagtatttttagttgaataatagtgggtatttttgttttgttgtagattttagaagaaaggtttttagtttttttttatttagtatgatattagttgttagtttgttgtagatggtataatttttaaattaattgattatagttaggaagtggatattttaatttgtggtattattattagatttatattttggttataagtttgaagaggagttgaaaaatgtatatgtgatgtatatgttttttatttggttttttttttttatttttttgttttataatttatataagttttttttttagttatttattaattatttgaatttttgaggaatttggggttaaggtaaattagaataaaattgtttgaagaagagtaagttttttatgttttgagaaatttttggggttttagaaataattttattgttttttttttttagttattttggtttttttttaaagagaatattaatattttgaatgttataatattaaggttttgtttttttaaataaagattttaaaaaaaaatggtttttgtatgatttagtgtgaattaaattttatagtgtaaaggattttatttttttaatgtagatttttaaatatataattattgatgtttataagtagatttattatattaaagtatttagtaaatttttgaatggattaggttttattttttagttttattttgtaaatttaagttaaataattaaggatttgttaaatatttgttttaatattaagtttttgtatattggggtttttttttataagttttataagtaattttttgttttttttgtttgtttaaagtagttatgtttgttgtatttgttagtatttgttttataataaatatattgggtgtttttttatttagatttggtaattattatttttgtaaatgagatattatataagataggaaaaagaatagtatttttttaagaagaatagtatttttttatattaatagtttagagttgattgtttttaaaatttagtggttttaaaataataattatttattattttttatgagtttataaatgaggtgggtagttttgttgatttggttaagttgaatttattttagttgggtatatttagtgtatttgttgttagttggttggttggttgtagtaatgaatggtgaaagtaggttgtttttaatttttttatatagtagtattagagttataaaagaattagtagaattatgtaaaattttttaagatttaggtttggaataattatatttttattatattttattggttaaagtaaattatggggttagtttagatttaagtgggtggaggagttgtaattatattgtaaaggagtgtgattgtagggagaggtgtttttttatttttatttttttgtgatttgttatagtagttgtaggaattaggtgtatttaaaattttgatttttttgtgatatttgaattgtttatgaattttgtttttggtggaaaggtagaattattgtgatagaaggataaaattttggaatttagagattaataaaggtttagattttagttttattatttatttttgtaattttgtagaagttaatttttttgataggtatttagtaatgattgatttatttgaattttagattttttatgtattttaaagaaagggttaggtaaatgtaaagtatttatgtaattgtttttattattgtaaatttggtttttatattttatttaaggtgtaagatttagtgttttttttgaattaaaaaggaagagaaagtgtgttagggaaaggaagagaaatatttgattaattgtggttttaataaagtgattatttattgggggtatttttttgtaagaaaagaatggttgaggtttagagttaagagatataaatttaaaagtttttttggggtaggattttttgtgatttatgggttgagaggtgtaatattagatatagttttagtttagattttttttttaaagaattgtagtttattttatatatattgggtgttttaatattatatgtggtaattattatttttataaattaggttttatataagataggaaaaagaatagtattattttatattaataattgaaagatgattgtttttaaaaaattaaaagggttatatagaaataaaattatataaattttttgtgttaaatatagttgttatattggatgaggattaaatatttaaatttatttaattagtagtaatagaaaagatgaaatatatatatagtaaaattagattaatttaatttatataaagggttagatattttagaatttagatagttagagatgttgattagagttaatgttttttttaggagaggtattaggtaagtgtttttaaagaattggaaattgagattattatttttggtattatttatttgtgaatataagtaagtttgaatttttttgtattatagttattttttatgtaagtttttttttttagaagaaaagaaggtaatatttgggtgtaattttttattaagggtgaaatttagtgtagagagtaaaggtatttggtatagaagtttttagttttttttgtttttaagttgaattgttagtttttatggattgtagtttttgttgttttgattgatattttttaatttattttgtattatttatttttttaagagatagggttttattttgttatttaggttggagtgtaatggggtaaatttggattattgtagttttgaatttttgggtttaagtaatttttttattttagttttttaagtagtttggattataggtgtgtattattatttttggttaattttttaaattttttgtagagatagggtagtgttttgttgtttaggttggttttatatttttggttttagttgatgttttggttttagttttttaaaatgttgggattataagtgtgagttattgtatttggtttttaattttattttttataaagattatttttaattataaattaatggaaattttagtttttttagatatatttgggatttaaggatatttttttaaatgattaatgttaattttatattaatatatttttgtaaaatttataaaaatggattagtaaagaaagatttttaatttgggaaagatagttatttggagagaagagaaatttaagaggtaggttgagtttagtgtttagaaatgagaggattataaagagatagttataaaaatgtttttttttatattgtttgttgatagggtgtattagtgaaggttttattaaggattttgtatttttttagtgttgtattgtgtgtttatagggaggaaagataaattatgtgttttttttgattttaaaggagtttgtatttggttagagagatatgatgtagatatatgaaataattaagaaataattaattgtagtaggtgttgaagaatatattaggaggttagagaatggtagagttagtgtgggtgaaggtatagtttagagtattattagatgatttttttttatgtaaatttatattttttttgggttaagtattattttggtatgtagtagttttataggtaatgttttaaggttagtttgaggtaagttgtaaaagttattatattgagttatggtttttttttgtgtggggggaggggaatggtattttttttttgtttgttaaattaaggaatatagtgtttttttaaatttgttttgttttagtggattgttaaaaagaagtgaatgaatttatgttttattagggaaaggttatagtggaatattgaggagtaaggggtatttttatttaataaatgatataatttgaaggaatgaaattataaggatggaattttaggtattaataaaaagttgatgagagatattttgagataaaagagtttttttagtgtaattgagattatagtatttattttatatatataggaaattagttttatttgttttttttatagagtagtagttgttttgtttttttttttttttttattatttattttaaatttttagttttttattgtattttatttaaattttgatatttttaagttatagatggtgaattagttaaaagtagtattaaaaattagtggtatatagttatatttggaatgtagtaagaaaaatatggatttttgtatattattttttttttttgtttttatttttatttaagagttatagggttagaatttaagagtttgagtttttgaaagtttttaaaaattttggatgattatttatatttagaattattgtattaagaaggataataaatatgttaataaattttgttgttaaggaggtgattatgtaagttggaattttgataatatgaggagaattttataatagttaaatagtttatgtattagttatattataataaagttaaaagtagtaggtttatttgatttttttttgaggtttattatgagtttagagagaaggaatgtggatatatagaggtagttttagatggagaagggtattaggtgttatggaaagaattatgtgtaagaagtaaagaggtgttttgaatgttttagttttgtttaggtgtttgtgtttttatatgagaatttatttatagtttttttttgttgtaataatttttggttttaattgtatttgtgagatagtaaaaagttatggtttagtttttttttattgtattattttattaatgtattttttttattatttttgtgtgaaatataaatttttttggtttattgtgattatgtaaggtgtatgttaattttttttttttttttatattttttagttttttgatgggtaaaaattttttttattttgttttagaaaaatttttattggtatagatttaattttagggagttttttttgaaagttaaataatattgagaatttatgaaaatataatgtagagtattatgtttgttagtatattagtttaaatagaagtggtttatgaaaatttttgaaatgttagattttgttttgtgttttgtatttttttaaatatttatttagatattgtttagaatgtaatatgattattttgaaataaagatttttttttagtttttaaaaaagttattttatatattaatttttatgtttttttttgattaatttttttagtagtgtaaatagtttttagggaagtagattttttatagaaattgttaagtggttttttgttgttagtatggttattaattttttggttattttttatattttttatattttttggaagtggataatttatttgtaaataaaagtgtataatttgtattaaaaatttttagtaataatttaatttgtaaaatagatgtgagtagtatgaatgtgtgtgatatgtgtatatatgaattatgttttttaaaaatgtattatagatatttttttgtgtttaaataaatttattttattttttttaatagttatatgggtatattataatatatttaattaggtttttattaaaagaattttgatttttttgtagttattatagtgttgtagtgtgtatttgtgtatgtatttttgtgtgtgtatttttgtatgagtgtatatatattttttttttggttattttagatttttttttaggtttaaattttaggaaaggttttgaaattgttttaagtatttttagaagtattaaattatggtttttttatattttttttttagaagttttatgttatttttatgagtagtttttagtaatttgttttgtataaaatttttgaaaatttttatttaaaaataggtggtatgattagatttttttagttgaaagagtgaggttttaggaaggattttggagaagttgtgtttaaatatagttgttgatttgatgtttgtttagagtttggtaaggtgatgtgttgaatttagtgtttgtttgtatgttagtatttttttattgatgagatttgtggtttttattattttatggtaattattttaagttataagatggagtttttagaaaattagtagagtatgaaggtttaagtaaaatatatgtgagtgtatgtatgtgtgtatataaattattttttttaaaaatgtattttgggtatttaaagaatgaggatttttgaaggattttgtggaagttgtgtttaagtatagttgttgagtgtatgttagtttggagtttggtaaggtgaagtgttgaatttagtgtttttttgatttattgttttttttgatttattgtgttttgaagtttttgttatttgggtttataaaatagatttttgtatattgttttttttttttgtttttgtttttatttaaaagtatagtggtagaatttaagaattagagttattaaaaattttttagaaaatttggatgattatttatttgattatgttttttttatttattatgttttttttttttttgagatagagttttgttttgttgtttaggttggagtgtagtggtatgattttggtttattgtaagttttgtttttttggtttatgttatttttttgttttagttttttatgtagttgggattatagggtttgttattgtgtttggttaattttttgtatttttagtagagttggggttttattgtgttagttaggatggttttgattttttgattttgtgatttatttgttttggttttttaaagtgttgggattataggtgtgagttattatatttggttttttatttattatgtttttaagtttttgtttttatttgttttattgtaaaatattttttaagttaatttggagttgaggtaaatttttaataatttaaaatttggggaatataaatattggataatgattattttgaaaaaataatgaaggtagtagtataatattttatatattaataaaatggtaaaataagatagttgttgaaggatagaaagagtaattgaagttaggagtttattttaatatattttttgtgttatattataggtattatattttttaaattttttttattttatatatataggaaaatatatgtgtgtaagaaataataaatatttttttgtatttattatttaatttaaggaatagtttattgttattttttttggtgtttgttggatgtttttttttagttatatttttttttttttttatttgtaggattatattagtaaattttgtattttttgtattattttgttttgttttatgattttattatttatttatatatttttaaataatatattatttagttttatatgttttaattttatgttgtggaattatattaaatgtagttttttttttttatattatattttaagttttagggtatatgtgtataatgtgtaggtttgttatgtaggtatatatgtgttatgttggtttgttgtatttattaatttgttatttatattgggtattttttttaatgttattttttttttagttttttattttttgataaatgtagtttttataatttgtttttttaatttaatattgtttgtaagatttatttatgtaagttgaagtttttttatagagatttttgttaagttttttaatgaatatagtatatatatttttttgtttttttgttagtggatatttggattgtttttagagttttgttgttttgaataatgttgttgtgaaaatgttttttgaaatatatttataagagtttttttttttttaagggaattatatttagaaattgaataattagattataaggtatatatatttataatttttgttaggtaatgttaaattgtttttaaggagtgttagaagtgtttttattaatttttattagtgttagttttttatatttgtggtagtatggtgggtgtgaaatatttatgtttagttttttttggtgttatttaataatttttataaaaaatatttagaagttaaggtagttttttgtttttgtttttattttttgtttgttttgttttaatgtagatattgagattatgatttggaataaatattggttgtaaagtttttaaaaggaaaattttttttggtattttggagtttttttggtattgaataaaataagtatgttaaattatgtatgtgtagtttagaagttagagtaataattgtgattgttgaatagaatggtagtaaaaagtttttaaatgattgtattgtataagggatatttgttgtgggttagttttagtttttttaatttttatgttaaaagttgtaataaggtttaagggtttatgtttgataggttagatggtgattagttgtgataaaatatagggaatttttgtaaaggattttaaaatttatgtagtagtttgttttatttgtagttttgttttttaaggttttagttatttgtagttaattgtgttttgaaaatattaagtgaaaaattatagaaataaagaattgaagagttttaaattttatgttttttatttattttatttgggatgtgaattatttttttgtttagtatttttatgttgtaggtgttgtttgttttttagttatttggtagttatttaggttattagattgatttttttagtattataatatttggttttaagtaatttttattttattttatagtggttttaaagtgtaggagtggtgattttggtaatttagatatgttaaagagaagttgtaaattgttttttttaagtgaaagatgaaaattttagatttatatataaagaaaagaaattatatgttgagattgttaagatttatgataagaatgaattttttatatatgaaattgtgaagaatgaaaaagaaatgtgtgttggttttgttgttatattttagattgtaaaagtttgtagttaatgtgtatgataagtgtttagttaaaaggaaaaaggtatttaaggtaagtatatatagtgtttggtattatttgtgattttaggtatttattgggggttttttgagtataaggggagattatttttttagtgttaaatgaatattaaggaatagagatggggaagaggttggagaagattagtttagtagtttgagtataggtaaatagttgtttgagaaagaagaaaaatgtgattagtattttattttagtaatagtggtatagataatgataaattatagttatatagaatttttagtatttatagaatgtttatatttgtgattttatttaataataattttgaaagaaaggtattatttattattgttttattgataaagatataaaaggtaagagagatgaaatatattggttaatgatatttatttggtaagagatagggatggggtgggattttaaggttttttttgttaagtttatggtttttttgttttatatttttttgttttttgattattatggttgtagtttttattgtggataatgtttgttagtaagtattgattttttgtttttagtatttttatgttttagtaaggattggaaagaaaaagttaggagtttatagtttgttggagtaatagaaaagaatgatatgaaatatgaagagattaaaatgatttataataaggtgttagattatgtagtaaaaatttgttttagttgtaagttaaaagtaagagtagtttttttagaatggaatagaaatgttggaattaaaggaatttttaaagttgtgaattttttttaagataaatatgttttattttggtaattatggtattattaatttgataatttttagggagttatttaatattatagaagatgtatatataatgataaaagtaaatattttatttttaaggattataatttaatttaaaataaaattttttttttttttggtttttggttaattaaggatttatttaaatattaaagaaagatatatagaaaatatttagtatatttttatatttttattaatgttttttatattttatatagatatttgatttggttatggtttagataatttatgaaaatttaaaggatagattttaataattttatgttaaattgatagatttttaggattagattgttattatttttagatgtgaagtttttaattatttataggtttttgatattttgtttttatatagatttaatttttttttttttaaatttttttttttttagttgttatttgattgaaatattgagttattaaaaatttttaagtgggaatttttgtgtttttttatttattatgaagttgtttaaataagtaggtgtttgaataggagtagaaatagtaataggttgaagttagattaatatagttttagttaaatgttgattttgttaaagtttgggaggattggtgtggtattttataatgtataagtttgtagttggtgtttttaatatgttggttttatgttttatgatttttttttgtaaatatgtagtttaaaaaatataagttattttgttgtagaagatatatttgtaaaattgatgtattttttttaagtaaagttggttaaataataaggatatatttataattaatgaatttgagaagaatgttgatgatatgtattattttttgaagttaatattttttaggttttaaataaataaaaagtaggttatttttgtttggagtgtatgtaaggggtattattttgtttttggtttttggttgttattttaaggtgttataaagttagttaaagagagtaattataatatattgatagtattttttaatgtgtttttgagttatttgagaattttatttttgaataggtagtaggaaattatttttgtagggtagtatgggtaaagggattggagggattattattataaagatttattgaattgttttagtattataatattttaaattaaaggattggaaagagttagattttaatttaatttgtttttttatgaatttttagttgggtttatttaaaaagaaaaaatttgaagattgtaagattttgaagatattttaaaataggtgaattttaaggtgtattttaaatttgagattgataattgaatatttttttattttttgatttgatattgttaaaatgaatgaggatttagtgttttagtaagtttggaatagaatgatattaatttatttttttatgattgatttttttttgttttttaatagattaaattttattgtagaatagttttttaatttttggattattgatatttttgattggataattttttgttgttagggttgttttgtgtgttgtaggatagttagtaatatttttgataattataaatgttattttttgtttttatggatttgtttattttggatattttgtataaatagaattatatatatgtggttttttgtatttggtttattttatttaatatgtttttaaggtttatttatattgtagtatgtaatagtattttattttttttttatggttgagtaatattttgttatgtggatatattattatattttgtttatttattttttagttgatggttttttaggttgtgtttattttttggttattataaataatgttgttaagaatatttatatataagtttttgtgtagatatatatttttattttttttgtgtggatatttaggagtagaattattggattatatgataattttatgtgttattttttgaggaattgttaaatatttttttatagtggttgtattattttatatttttattagtaatgtataagaattttaatttttttgtttttgtttatatttattaattgtttttttttattagttaattgttgtggtttgaatgtttgttttttttaaaatttatgttggaatataatttttaatgtggtagtattgagatgtgaggtttttaagaagtgtttgggttattagaggtttgtttttatgaataggttaatttatttatgagttaatgtattaatgggttattattggattgggattagtggttttataagaagaggaagagaattaatttagtaagtttagtttttttattatgtgattgttgttttgtgttattttgggattttgtagagagttttttagtagtaagaagttttttattagttgtggttttttgattttggattttttagtttttagaaatgtaagaaatttattttttttttttaataaattatatagttttatgtatttagttatattaatagaatatagattaagatattattttattgggtatgggtattttattgtgttttttatttgtgttttttaaatgattaatgatgttgaatatttttttatttgttttttggatatttgtgtattttttttgaagaaatgtttttaatattttttgtttattttaaaattaggttgtttttttattgttgagttgttggtgtgtgtgtgtgtgtgtgtgtgtgtgtgtgtgtatttagaatatatgtgtatgtatatatgtagatatattttaaatattagatttttatgaaatatataatttgaggataattttttttatttaaaaggttatttttttattttttgatagtgttatttgatttataagtttttaatttttatgaagtttaatttattttttaattttttgtttttggtattgtatttttaaaaagttgtttgatttaaggttaaattgatttttatttatgtttttatttaagaattatagttttagtttttatatttaggtttttgatttattttgaattaatttgtgtatatggtgtgaagtagggttttaatttatttttttgtgtaatgatatttagttgttttagtattatttgttgaaaagattattttttttttattgaatggttttgatattttgttgaaattaattgattataaatatataggtttatttttggatttataattttatgagtttgtatgtttaattttatgttagtattatattgttttgattattatatttttgtataaagttttgaaattgggaaatgtgagttttttaattttgtttttttttaagattattttgtttatattttgtgtttgttgtaaatttatatgaattttaaattaattttttatttttggaagaaaaaaagaggtaattgaagtttagatagggattgtattgaatttgtagattagtttggggaatattgttattataataattagtaggttttttaatttatgaatataagatttttttttatttttgtagatatttagttttttttattaatattttgtagtttttaatataaaagttttgtattttgattaaatttatttttgaatattttgggttttgatgtttttatgaatttgtttttttaattttattttaagattgtttattgttattgattagtaatgtaattgatttttgtgtgttgatttttgtattttgtaatttagttgaaattattgattagtataatagagtatttaatagatttaggatttttatatataagattatgttatttgtaattagagataattttatttttttttttttaatttggatattttttattttttttttttgtttagttgttttagttagaatttttagtgtagtgttgaatagtagtggtgagaatgagtatttttgtgttggtttttattttgtggggaaattttttagtttaagtgtgttgttgtggggtttttatagttgttttttattagattgagaatgtttttttttgtttttagtttgttgagtgttttttttttgattgttttaattaggaaagggtattagattttgttaaatgttttttttgtagttattgagatttttgtgtgtttttttggttttttatggtttattatattaattgatttttatatgttaaataaattttgtgtttttgggttttattttatttggttatggtttataattttttttatatatttgtagatttagtttgttagtattttgttgaggatgtttgtatttatatttataagggatattggtttgttgtagttgattagtaagtatagtaagttgtatagtttattaagtgttttttttgttttgggggagattttgagaagaaggattgttggtaattgttttttaaatatttggtaaaatttattagtgaagttatttggggttttttttggaagttttttgattattaatttaatgtttttatttgtttgttataagtttatttagatttttttttttttgagttatttttgatagttggttgaggaatttgtttattttatgtagttatttaattggttagtgtataattatttatagtatttttttataattttatttttttgttgtaaggttagttataatgtttatttttttattttggattttggtaatttaagagtttttttttttttttttttttggttagtttagttaaagtaaagttttgtttgtttttaggggaatagttttttttttttttttgaggtagaatttttattttgttatttagtttagagtgtagtggtgtaattttggtttattgtagtttttgttttttgggtttaagagatttttttgttttagtttgttaagtagttgggattataagtgtttattattatgtttggttaattttttatatttttagtagagatggggttttattatgttgggtaggttggttttgaatttttgattttaggtgatttgtttgttttggttttttaaagtgttgggattataggtgtgagttattgtgtttaatttagttttggttatttttgttgatttattttattgttttttttttttttattttatttatttttatattggtttttattatttttttttttatgtttgttttggatttagtttttttttttttagttttttaaggtggataattaagtttttgatttgaatttttatttttttgtaaggtggttatgtattgttatgaattttttttttagaaatgtatatgtttttattgtattttttaagatttggtatgttgtatttttgtttttatttgttttaaggtatagttttttgatttttattgtgattttttttttttttaatttgtttattatttaggaatttgttgatttttatatatttgtgaattttttagatttttttttttgttaatttttagtgttattttattttggtttgagaatatattttgtatgatttttattttttaaaatttatttggtttgttttatgatttaatatattgtttattttggaggatgttttatgtatatttgagaagaatgtgtattttgtttttgttgggtagagtgtttgataggtgtgttggtatatagttttgtttaaatttgtttttttgtagatttttatttagttgttttgtttattggaagtaggatattgaaatttttaattaatattgttgaattgtttattgttttttttagttttgttattttttgttttatatattttgaaattttattgttaggtataagtaagtttatgattattatatttttttgatagattgatttttttattattatatagtgttttataagaataatttttattttaagtttatttgtttatattagtatagttattttagtttttttttgtttattgtttgtatggaatattttttttttttattttttatttgtgtttttgagtttaaggtgaatttttgtagatagtaattggatttgttaatttttgttttttatttggggagtttaaattattgatatttaatgtaattattgatgaggaagattatttttgatattttgttatttgttttttttattttgtgttttttgtttttaaatttttttattattatttttttttttttgtattatatattttttagtgtaatgattttaatttttttgttattttttttgttgtatgtttttagttatttttttagtggttgttatggagattttattgttattttaatagtttaggttgggtatagtggtttatgtttgtaattttagtattttgggagattgaggtaggaggatagtttgagtttaggagtttaagattagtttgggtaatttattgagatattgtttttataaaaaaatataaaaattagttaggtatggtggtgtgtgtttgtagttttagatgtttgagaggttgagttgggaggatagtttgagtttaggaggttgaggttgtagtgaattttgattatattattgtattttagtttgggtattagggtaaaattagtttaaagaaatgaaggaaaaaaaaaatttaatttagattaatattaatttaattttaatagtgtataaaaattttgtttttgtatattttttttgtttttattttgtgttgttattgttatagatttttatttttttatattgtgtgtttattaatgtagatttaaaaatattgtttagtagttgtttttagaatttgatatggagaaaaggagatataaataaaagatgtatttttattgttttgtatgtttatttatgtaatttttttttttgatgttgtatttttaaaggtaaagtagggttattgtgagtgtttttttgttttaatttgaaagattttttttagtatgtgttggagatatgttaatgatggatttttatagtttttgttatttgggaatgtgttaatttattttttatttttgaaggatagtgttggtaggatatagaatttttggttgatatgtaatttttttagtattatgaatatgttattgtattgttttttgatttttatggtttttgataaggaattaattgttaattttattgaggattatttgtttgtaatgatttgtttgttgtgttgtttttaagatttattttttgtttttagtttttggtagtttgattgtgatgtatttaggtgtgtattttattagtttgttttatttggagtttgttgagttttgtagatgtattttattagatgtgttaagtttttttgttattattttttttttaaataatttttttgtttttttttgttttttttgttattttgattatttgtgtgttgttttgtttggtggtgttttagaagtttttgagattttgtttagtttttttttttttattttttttttttttatttttttagattggatgattttaatttgatttatttttgagtttatggatttttttttttttaagtgatatttgtgagatgaatttttttttagagaattttttattttagttattttattttaaaatttttttttggtttagttttattattgttatttttatattatttttagtttaatgagatattgttttatatttttttttagttttttagatatagtttatgttattgaatatatttaaaatagttgattttaagtttttttttttttatttttttggagatggagttttgttttgttatttaggttggagtgtagtggtatgattttagtttattgtaagttttattttttgggtttatgtaatgattttaagtttttgtttatgaagtttagtatttgggtttttttaggtatagtttttgttttttttttttttttttttgtgtattttgtttttttgtatattttgtaattgttgttgttaattggatattttgaatattatagtgtaataattttggtagttagattgttttttttttttagtatttgttgttggtgagtattgtagatgtttgtttagtgattttttatggttaattttgtaaattttatattttttgaagattgtgggtattttgaagtttttgtttgttagtttagtggttatttaataattaatagagattttattaaatgtttagaagtaaaatattttttagtttttgtttatggtttttgtgtatgtattagggtaggttttgaatttttatttagggagtttataattttgttttagtttttattattagtttttgtagagtattaaggttaataggtggtgagagtttggagtttattttattttttttgagtatatatatagttttatttatgtatgtggttttttagatttttaggagtatgttggatttttttaaagtttttatagattttttagtttttttttttaatttttagattagtgtgttgttttttttaatagttatttgttaggtagtagtaaattaagagattagtataaatgtttttaatttttttatttgttatgtgttttagggaagtattaagttagttttaagttaggtaaaataaagataatttttttgaggtggttttttatggagttattagataggtaaattaaataattaattataagtttttggttggatatagtggtttatatttgtaattttggtattttgggaggttgaggtaggtggattataaggttaggagattgagattattttggttaatatggtgaaattttgtttttattaaaaaatatgaaaaaataggtggttgtggtggtgggtgtttgtagttttagttatttgggaggttgaggtaggagaatggaatgaatttaggaggtggagtttgttgtgagttgagattatattattgtattttagtttgggtgatagagtaagattttgttttaataaaaaaaaaaaaaaataagtttttatgaaagaggtttattttgttgttttttatattaggaatgtggaatgtggattgttatttttatggttattgttaagttaggaattaagggatagatggggattgggtaaaatattatagagtttgttgtttttattaagaataagttggggaagagggttgtttttgttttttagtaaaaattttttgggttgttttaagttgttgattaatttttaggttttgaaaaagtttagtttgatagtttttgttttttttatttgtttttatggatatgtagaatttgagtttttttttttattagttttgttgatattgttttaaaagtattttttgtaaaatttaaatgttgttttttttaaggttagttaataattaaaaatattgttatttttttttgattttggaaatgaatttgtattgattaaaatttaatattagaggttttttaagttgttttattatttatttaaattttagaatttaatgatttttgtatattgtttagtatattggtggtttttaattgttataagtttaattttggaataaatgaattttttgtgtgtaagtttttaattgtttggaaattatattgatgttttttttattaaattgttatttgtgggatatttaggaattttttatagtagttgataaatattttaagttagtgtttggtagtattgtttattaggtaatagttttagtagtagagtgatttttatttataaggtagtgtttgagtaattgtttattagtgtttttttaattatttagaagaattattaggggttatagaggtagtttagagagttgggtgtaagtagagaaatttatttggtttgtattatatattttatttttagagaagtttttttttgaagaaggagttttaaggtttaaaaaattattttgaatgttatttatattgtattttaattttattttagagaaattaatggaaagtagaaaaattaaggtattgatattagtgttaagaatgttggttaaagtttttggtaattaattttttatttttttttttaattttattaaaatttaataatttttagtttatgttgtaatttagattaaggttttaatttaatgaagttaatgttagtgttgttgttatttattttgtttttagttatttagttatgttttttatttatattgaataagttagtttaatttaataattaaaaaagaaagttgttgtttaagttaagaaaaatagtttgaattgtttttaaattaaatatttagtagattttttagttgttgataggagaatgtttaatttagaattgttttgtagtagattattttattttatttttgtttttttataggatagtttatttgtttgaaattgtatttaatatgttgtgatttttgtgtgtttgtttttattttttattggatagatttaagataaaatttggtattttgtagtgtagttattagtttatagtagaggaaatttatattagaatttggttgtgtatttatatgtatttaatttggaggttattttgtttattgttgatatattagttatattagatgagtttttaatgagatattagaaattttggaaatattattaggtggaatagtgtttttaatgttttattaagtgttataggtaagataaagtttagtattatttgtggtattaaggttaggtgtttaaagatttgtatttttttattgttatgttgaaattgtttttttgatgtagtaatagaaaattttagattaggtttaagttaattagtaaataaagataaaagtttgatattattttaaatattttgtgtttttaaataatttaatagtgatttaattagttatttttgtagaaatgtaattgataaattttttatttttttttaaattgttattttgaattttatttgttttttaaagttgttttaagttttttttaaaaaaaggtagttatttataaatttagaaaagtttgatagtatagaaagttatagaaaaatgtaaatatagtttaaaattgaattgtatataagttattagaagtatttttattaagtttataaatattagtagagtggaatttatgtatttaatatgtttgaaatttttgattaaatattgtgttatgaaaaatattttagataattattttttaattatgtgtgtgtaaaatgtggttttttttgataattaagtagtttttttgtgtgttaaattgtgattttaaaattttaaagtatttaatagagtaaataaattataaatattatttaaattgtatatatttgtatatgtattttttataaatagtatatgggttttaagtttttatttttgaaatttagaaatgggttttttttttttttagtagaaataaaaatttgatttattttatttatttatttattttatttttgagatggagttttgttttgtggtttaggttatggtgtaggagggtgattttagtttattgtaatttttgttttttgggtttaagtgatttttttgttttagtttgttgagtagttgggattataggtgtttgttattatgtttagttaatttttgtatttttagtagagatggggtttttttatgttgggtaggttggttttgaatttttggttttaggtgatttgtttgttttagttttttaaagtgttggggattataggtgtgagttattgtatttagttaaaaatttgatttttaaaaatttaaattgaagatagaattgtgtattttagtatatttattagtagttttgatgttatattatatggttgtttattatttaaatagtttgtaaaagtaaatattttaggatttatgagtggtagaaggattgagtattttgggaaataagagagaatttttgttgaggatggttgaggaagagtttaagataataataggtagaataagtaaaaatttagagatttattgtaggtatttaagtatgtatttgttagaatgaatggttgaatttggtatattgaggaatattgagaaagttatattgattggaagatagtttttataagaaattggtgagatatatgttatagtttagattttggtgagttttgttaaagtttgggttttatttttatatggggagaaagttttataggggtttggaaatgaggtttggagttgttaatggggatatagtgaggttttagggtagtggtttttaaattgtttaaatttaaattttgatgataattttgatataattattgtttataatttttattttagttgtattggttttattaaaatatttttattgattttattgattgttttttatgtagattaatattataaatttgaatgtataaaggaagttttagtagtaaaatagtaatttttatttgttttatgtattggaggttttgtataagatttaattttttttttttttgaaatggagttttgtttttgtttatggggttggagtgtaatggtgtgattttggtttattataatttttgttttttgggtttaagtgatttttttggtttagttttttaagtagttgggattataggtatgtgttattatgtttggttaattttgaattttagtagagatggggtttttttatgttggttaggttggttttgaatttttgattttaggtgatttgtttgttttagttttttaaagtgttgggattataggtgtgagttattgtgtttggttaagatttaattttttaaaagaaaatattttgttaagggtttggaaatttttgttttagtaagaatggattaagattgattaaaattaaaggtaaagaggaggtttttatgtttggaattttttgttaatatttatataatataattttttttataaatatttaatggtattagatattagatggttataatggtaaaagtgtttaaaggatgttattatatttatgatttatgattaaaatgaatattataaggttatttttttttagaattaaatatgttatttttgtggaaaatttgtttttaatgtagaagttgttttagagttttttttttttttttatgtttttttatgtttattgttgagttaatatgggttttattgaatgattaagaaaaaatattttaggtggggagttttgtatatagtaaatgtttaatttattggggtggtgaatgggaagtgttgttggtaagagaggatgggaagagaaatttatttaaatttttatttgttttatagaatataaattttttatttagtagtatataataatttaatgattaaggtattttaatttttttgtttttagatgaaagaattattgtttggtttgattaagtatttagtatttatttgtttatttaagtgtttatgtttttttgttattttagggttttatgttagttattaattaaaagaattagttttagttttggaagtttaaaatatataagagaaggtgaggagtaataagagaagatgaagggagatttttggaatggtttatgaatttttagtaattatattattttaaaatagataaattataatgtagttatgaagatatgtattttttagtgaagataattaaaatgtttgtatagaatttttttttttattgagtgttagaaattttattttggagatattattttgtataatataaaaagaaaaagtgagtgtggaatttaggaatttatgtggttttaggaaattttttaagtgtggaaattgaaggagagtaagagaaagggagtatggtatttttttgtttgtagtttatgaggtgggtttaaattgttttttgttaatgtagttgtatattgaggattatagaattttttttaaatgtttgtagaattattttttatttattaggtaaaatgtgtattttttgattttttttaattttagtttttttatgttgttatgtttaattttgtatattatatatagttttgttaaattgataaagtggtgttttttgttttttttttttttattggttaaaatttaaagagaaagtggaagttagaaatttatttaaaaaatgtaattttttttgtaattattaaagtattaatttaaatttgaattttttttgtgtataatttttttttaagttatttattatgttgataaatttgtttttttgtggtaaatatattagtaatatgttataaatatgtaatttttaatttatttatagttgatgtttttttagttttttggatttaaaatataagtattgaagaggtgaggaagtattattgttgttttagtattattttgaaattttgtttataaattatataatttttaaggttatgaatttagtatttttttaggtattaattattgggataaagatagaatttgattttatttatttatttattgattgaagtttaatttaaattttgtatttagtaagattttagaaataatgtgtgtattttgatttgtaaattaattttagtattttgtgtgtatatttttttttatttgggtttttaaaaggaaaagtaatgtatatttgatgattattagtattgagtttttttagtaaaaagtatatgtttataaagaagtataggataatttagtaatttaataatgtgataatatttgtgtgtgtttttttttttgagaaatataaattgtgagaaatagaaaagtaaaagaagtagtagtagaaatattattataggattaaaagattgtaggaattaaaattttaaaattattgggtataatgtattaaaaatagggtagtggaggaaagggatagtttagattagttttgagggtttaaagaaagtattaaatattgttattggagtgatttgttttgttatttgggtttgggaattaagtgaaattgttgatatattagatagatattttttatttattttttttttgataattagggtttattttttttattttttatttttttggatgttttattttttaatattaatattaatattaagtttttagtttttatgttaaaaattggttatttaaaataatttaaattaattttagtttaattggtttaagtttaaatttattttaagattgatattgtgttttttaaaaattttatttaaaagatatttaaattgatgagaggatattatttattttattgataaattattattgtaagtttgtttattgagggttagttatttggtttaaaaatgttgagattatggaaagtggattggaatattttggagtaatattaaaaatagtatttgtaataatttaataaatttataaatttttttttttttgttgatttattttgaaaagatattttatgtttttaggtattttttttttgtggtgtgattggtagatagggagtaaataatttattgtaaatgggtattatgttagttggttttaggtagtattaagtttgtgatttatagttagggttaggaaaatgttttttaatttgtttgtttttgttttttttaaatattaaaggtataattgtattaattattaagtattttataaggttttttagggtttataagattttttaggaatggtttggaagttattagtattgttttattgaatttgaatatttttaatatgataatgagaagtttttaaagggtggttttatagttaaatggaattttttaaattggtttgttttttatgttgatttatttaggattatatttgggagtttttttgttttatttttaatgtatttaatttattgattattattatttggggggaaaatgttatatgatatttagaaattaagagttttggagttttttttttattagatgtatttatttatttatttattattttttaaagatagggttttgttttgttatttaggttggagtatagtggtatgattttagtttattgtatttttgaatttttgggtttagattgtttttttattttagtttaagtggttaagtattaagtaagaattatttggtaaattttaaggttgtatattagattttttaaattagaattttggggttgggtatttgaattttagtaaagttttttaaatgtttttggtattgtttttaagaataattgataatataatagttgtggttattataggggtattttgttatatttagatataagtatattttgttttattgtattttttaaatattgtgtgtttattttgttttgttttatttataaattgaaggtttgtggtaattttatattaagtgagtttgttagtgttatttttttaatagtttgtgtttattttgtgtttttgtgttatattttggtaatttttttaatatattaaatttttttattatttttgtatttgttatgattagtgattagtgatttttgattttttttttttttttttttttttgagatggatttttgttttgttatttaggttggagtgtagtggtttaattttggtttatagtaatttttgttttttaggtttaagtaatttttttgttttagtttttttagtagttgggtttataggtgtgtgttattatgtttggttaatttttgtatttttagtagagatggggattttttatgttggttaggttggttttgaatttttgattttaggtgatttgtttattttggttttttaaagtgttgggattattgtgttagtttgatgttattattttaattgtttttaggtattataaattttatttgtataaggtattgtatttaattgataaatattgtgtatgatttgattgtttttttaattggttattttttgtttgtttttttttttttgggatttttaaatttttgagagataataatattaaaattaagttaattaataattttatagtggtttttaagtgttgaagtgaaagagttgtatgttttttattttaaataaaaagttagaagtggttaaatttagtgaggaaggtatattaaaagttaagataggttaaaagtaaggatttttgtattaaatagttaaattgtgaatgtaaaggaaaagtttttgaaggaaataattagtgttattttagtaaatatgtgaatgattagaaagtgaaatagtttttttgttgatatgaagaaagttttagtggtttggatagaagattaaattatttataatatttttttaagttaaagtttaattttttttaattttatgaaggttgtgagaggtgagaaagttgtagaagaaaaattggaagttagtagaggttggttgatgaggtttagggaaagaagttagtgttgtaatataaaagtgtaaggtgaagtagtaagtgttgatatagaaattgtagtaagttatgtagaagatttagttaagattattaaataatagattttttatgtagatgaaaaagttttttgttggaagaagatgttatttaggatttttatagttagaaaggagttaatgtttggttttagaggataggttgatatttttgttaggggttaatgtagttggtgattttaagttgaagttaggttttatttattattttaaaaatttgaagatttttaagatttatgtttaatttattttgtttgtattttagaaatgaaataataaagtttggatgatagtatatttgtttatagtatgttttattgaatattttaaggttattgtaaagatttgtttaattgtttagaaaaaaatgattatttttaaaatattgttgtttattgatagtgtatttgggtttatttaagagttttaatggaattgtataataagatggatgttgtttttatgtttgttaatatattatttatttgtagtttatgaattagggagtgattttaagttttaaattagtatattttgtaaggttatagttgttatagatagtgattgttttggtggatttgggtaaagtaaattaaaaattttttgaaaaggattggttattttagatgttattaagaatttgtgatttgtaggaggaggttaaaggattaatattagtagtagtttgaaagaagttgattttaatagttatagatgaatttgaggggtttaatattttagtttaggaagttattgtagatgtggtagaaatagtaagagaattagaattagaagtggagtttgaaaatgtgatggaattgttgtaattttatgagaaaatgtgaatggatgaggagttgttttttatggataaatgagtaaataaattttttttttgagatggaatttatttttggtgaagattttgtgaattttgttgaaataataataaaggatttagagtattatataaatttaattggtaaagtagtagtatggtttgagtggatttattttagttttgaaagagtttttattgtgggtaaaatgttattaaatagtattttgtgttataaagaaattttttatgaaaagaaaagtgaaattttattgttgtttattttaagaaattgttatagttattttatttttagtaattatttttttgattagttagtaggtattaatattgaagtaagattttttataaggaaaaagattataatttattgaaagtttaaatgattgttagtatttttaagtaatattttaagattaaggtaaatatatttttaaagatataatgttattgtatatttaatagattatagtatagtataaatataatttttatatgtagtgggaaattaaaaaatttgtttgatttgttttgttgtaatatttattttattgtggtttagaattgaatttgaaatattttagaggtatgtttgtattaatattattttgtaagtaaaaaatttagtatataaaaaaaatgtagaatatgttgagagtttagtaatatggatgaaaatgtttttttttaattgaagaatatgataaattataattagggaaggatataaattaagaaaatatgtttgagatagttaatttttgtagtttataatatgaaaatttattatattaattttagtaagaatatttttaatagttgttatttttttgggatatagaatttataaagtatatagtaatttttttatgattaattttaggattattttataattatttattttatattataatgtagtattaagataagtagattaaattatagaaggataaagtttttgttaagtatattttgttattagtatattgtattgtgtgtgtatgtatgtgtgtgtttgtgtatgtgtgtgattgtataaaatattagaaagttattttagaaaagttaaatgattaggaatgttgtgaagggattaagttatttttaaaattatataataaaattttttttatttattattaggttatttttagaatatttttttttaaatttgttataggttttttttatttgtttggattaaaattggtttgaaagtttaaaatggttttttatttatataattattttttaattagtttgtagtataggtgtaaagttattatatttgttaggttagtgaagtatgtaaaaattattattttttaattaggaattattggatagtttttataggattgttggggagaatttttataaagaaagttatatttttataaattttttgttattttatttagttgagaatataaaataagttagttaataatagagtagaaatgttttttgtaatagattaatattgattaaatgtgttattaaatgttaaaatattattttttttttttgtaagttatgtgttttatgttataatataaaagggataattgtttgtgttttatgatagttttgttttgttagatgttgtttgtttattttggtgaataaatgaagagagttttggatatatttttttttttttaataaaagaggaaaattatttttgtttgtatgtttataattttgattttttgaatggttttaatttttttaaagttagtatttttttataaagataggtgtttggaatgtgggtgatatggttggatagttagattgggattaaataatggaaggttttgaatattatgttaagaggtttgggttttattttgaaggtagtagagaattattatgtttttaagttaggattgatttgttttaagttgtattttagaaatattattttggtagttgtatataggatgagttgtatgttgttttgttttgtttggggagatagtttttgaagagagattatatatgaaggtagttatatgagttattattaaaggtttggtaagaagtagtaaaagtattaattggagtggtagtagtagggaaggaaataaaaggatagatgtgggagttatttggaaagtatgaggtaatttattgattttatagaattattggttttttgtttttattttatttatattgatttttttaaggttattagtgatttgtttgtttttaaatttagtgggtattttttagtaatttattgttggtattagttttgtgttagatattaggattttgtttgtaaaggtatttgttagtggtttttgtgatataattttgtttttagtttttttttttttatttttttagttttttggtaagttttttttttagagttttttagagttttgtgttaggttttttttttattttttttttttttaagtgattttatttttttttgttgttttagttattatttgtttttatgtaaaggatagttatatttattgtatttttagtttagatgtatttttttgttttttgatttatatttttaattatttaattgggtatttttttttggatgagttataggttttttaaatataatatgtttagaataatttattgatttattttaaggtttgtttttttttttttttgtagtttttattttaggaaatatatggtgttattaattttaaagtagaaatttggatataatttttaattattttttttttttttttgtgtatataattttagttattaggttttatagattggattaaataaatattttgtaaatttttttatttatatttttaattgtttttattttaagttaggttattataattttgtagttggatgattgtattattattttgattggtttttttgttatttttaatttatattttatattgtagttagagtttttaaatataaatatgtgattagattagttttttttttagaatattttagggtttttattgttttgagtatagtttaagggtttattatggtttatagggttttttatgatttggtgagttttttattgtataatttttttaaattgtttttattttttttttttttggttttgtgtttttgtataatgttgttttttatattttattttatgtttaatttttattttttttttattttttttttttttttaaaatttagttgaatattatattgttatgtaggtttatttttgattttttatgtttgggttagatatttttttttagtattattattgtattaggtgtgttttttattttagtatttgttttattgtattataattattgtgtatttgtttttatagtttttgttagtttaaaagttttgggagagtaaaggtttatgtttgtgttttttattgtggtatattttagtgtttagtatatgataagtttttaaaatatttgttagatgtatgaagaaatgagaaagagaataggaagagggtaagttttaagattaggaaataaggttatgaaagttgtaggaaagtagtaggttaaaatttagaagaagagtttgttttaggaaatattgtgttttaaattattataattgaagtaaaaatttaaggtttgggtgtggatagagtttattatttgataatagtggatattgatgtatggtagagttggagaggaagagagttagattttaaaatagaaggggtaaagttttttaagaagatagattatagtaagaaggattaggggatagaaatatgagtttgttttatttatagattttaaatatgaaatgatgagttattatgaagagagtaggtaattgtttagtgaagaaggggatgttaattttttttaattttgaattttttaggtagaagtagttagagaaggaatagttattattagatagtgttgtaaggaaaatgatatttttggggaaatttgtattttggtaaagtaaagtaattaagaaagaatatattattattgtttaataattgttataaaaagatagtaggattatttttgattttttttatttttttttaggaatttggaggattaagaagagagaaatttgtagaagaggtttttttttttgattttttttttattttagttttattatatgtaatgtaataataattaagaatttgtgtaaaattttattaggttggtatgtatggagagaaaaattatttagatgtttttttttgttaataatataaggagtatttgtagggaaaaatatttataaatatagtaagatttattttttttttatatttatgggaaaattttaagttgtgtttttgttttatgtgtgtttttatttaaagatattatatttaatatatattgttgatttattaatattgaatttatggttaatagtattataaattatgtttgattaaaatttatgatatatgtattttttttgtaaggtatattatagtttttttgtatatgggaattttaggtagtattttaggattatgtatagaggttattttaaatagtaaaatttttaataaaaagtataaaatttaaaaaatgtgttattaaatttattatgaaaaggatatttgtttatagtttgagagttaaaataagaaggtggtgtgttattttgtttgattttagttgggaatatgtatattagttgatttaaattttttgttattttgtgtttatttatgaattgataggaaagtaagtgtggatttgggggttataaataaaatgtagtaaatgtgtaaatttgtagatgtggaatttataagtagttagaattaattatgttagtttgattattaaattagttttttaaagtattattgtaatattttataatttgttttatttattgagtgttgtagtttatagttttattgggtatttttagtagttttatttgaagttatattttaaattttgtaattgaagttttaaagtatgttattggaaatatgagttgatgttgtgagataaaattaataggtaatttattattataattgtgggttagaatgtttaagaaattttggaggtttagagagttgagatgaatattgaagaattataggtaggtttattttgttaagttgtttgtattttgagggtgtagtttttaaattaaaaagatattaaatgaataaatttagatggttttattggggaatagagattgaaagttgatattggaatgtgtatttaaaaaaatgagagtttgttttggaaaggtagattgggtatagaatgtggagagttatatttgttaattgaagaaatttagattttattttttataaaataaagttattggtttttgaaggttgtataaaagttgtattttagtagtatatattttggtagagttgttatttgtttgaaaatattaatgttattttatataaatgatatttattttttggtgtttgatttaaatttttataatgagaatgtgattttatagtttttattggggaaggaagtaggttttttaggttgaaatttttgtgtagtaaaaattaatatttaagttagtttttggtaatttttagttttataatggtaaaatggattttttagaaagttattttttatttttttgaatagatattagaaataatatgtattttaagtgggatttatagaggaagggggtttttaattttttattagtgtgatgttttgtaaaaaaataattaatattagagttgaggtttagaaatagtagtattgggttaaagtttgtttttaagtgtaagtttttttttttatttgtgtgtgtgtgtgtttgtgtgtgttttatatagaaggaggaaatgttaattttagtttttataaatattaatgattgtaatttataaaaatgttatagattatattttttttttttgtaatagatgagaagattttgaaatttagtttttattttttagtttggtaagataatttgaataaattgtaataattgtaaaagaattttgaatatttgaatatttgatattttttatgttaaatatatattttttgtattatataaatattttagaaaagagagataggtagggaggaaagtgtttattaaaaagagttttattttttttgaaaagggattttttttatagtgttgtgtattaaagtttgtgttgtaaattagaaagtattgagtatatatgttgttgttttggtagtattagaagttgatttttattagttttatattatttattatttttgttaagtaattttaaattataaaagaattttatttgattttgtgatttttttgttttttgtttataaagaaaatattttaaattgaataatggtatgttatgtttttagtttttaagatagttaatgtgtaaaaagatatttaaagtatagttgtgttaagtttttgaagtttatagttgttttaattttgttgttatattttgttaatatattttaggaatattttattttagttataattaggatataaatattattttggtggtgatttttttgtaattatgatgttaattaaatttgggaaattttgatttgttagatttataaattttatagtaatataaaagtttaattttttatatatttttaaggtttttatatttttgttaaaataaagtattaatgaaaaatgaaaaaattataaattatgtttaggttaaattgatattgattttgttaaaaggttagatagaaatttgttttttttttttgttatatttttttttttggagattattttgtgtggattgaaggtttgagattttaggatttaggttagaatagattaggagattgtgttgtatgttaagtggtagatattatggaattttaagtttgttatgaaggaggagaagaagaggtataatgattttgatatagtttttgggttgattatagtagatattttatttgagtaagtagatattattttaattgtttgttgattatttttaatttgttagtaatttattttgataatttagatttaggagtttgatagtatgtagtgtatgttttataataatttgttgtttatgaaagttataatattgtatgtttagtataatggtgaagagtttgttatttggaatggtttatttatttgggatttatatatagtaagtttttatttaatattattagtaggtttttggaaattgtgattttaagtaaaataatttttaatgaaattaattttattataggttaattgatataaataagagttaagtttttgtggtatatttttggttataaaaatattattaaatttttaaataaagatttaaaatatttataatattaattattgaaataaatgtgagttatatatatatatttaagaataataaaaataaaaaataattatttatttaatttttggtgaattagtgagtgatagtgattatagtgatggtggatgaaattaaggaataaatatttgtaaagtgaaaattgtaagaagtattttttgttattatatagtttagaaataataattagggtaggtttgttgagtatttttaaattgtattgtttattgttatgtatttgaatgattattgtagattttatgaatttttattttatattaatttgtaggttaggtatagtggtttatgtttgtaattttggtattttgggaggttaaggtaggtgggttattggaggttaggagtttaatattagtttgattaatatggggaatttttatttttattaaaaatataaaaattagttaggtgtggtggtatatatttgtaattttagttatttgggaggttgaggtaggagaattgtttgaatttgggaggtggaggttgtagtaagttgagattgtgtttttgtattttggtttggtgatagagttagattttgttttaaaaaataataataataatttgtatttatttattttttaatgtgtttattttagtttagggtttagggggtttgtagtttatatttatagtttagagtaattgattttatagataggatgttattttattgtagggtgtatttaaatgtatatttatatttaaattgggattttttagatatgttagttattgtattatatatagttttgggatgtgggaggaaagtgaagtatttggagaaaaattatatagatatgggaagaatgagttaattttatatagatagtggttttggatagagttgggtaggtattagtttttttttttttttttgtggggggtgagggtggggtatggagttttattttgttatttaggttggattgtagtgtagtggtgtgattttagtttattataatttttattttttgggtttaagagttttttttgttttagttttttaagtagttgggattataggtgtttgttattatatttggttaatttttgtatttttagtagagataaggttttattatgttggttaagttggtttggaatttttgattttaggtgatttatttgttttggttttttaaagtgatgggattataggtgtgagttattgtgtttagttagtattatttttttttttttattaatgttaaaataatgttgaataaaatattatttaaagatttgttgtatggttattttttagttgtgtgattttttttgggaaagttagtaattttttttgagtttaaatgtttttatttataaaatggggttagtaataatgtataaggtttttgtaagaattagaattaataaagtatttagattataataattaattagtattagttgttgtttttgttattattttgatgtggtggttgtttggttttatttgtgtattattaggatatgttgaaataaaatttaagaattggttttataatattagaaaagtaaatttttgtatgatatgggtatgaaaaattgttgggagtttatttttttttttttatttaatttgttttagtttttttaaagtttagattttttaaatgagttatagtaaaatataatgtttaaaaatgtttaaattttaagtattatgttatagttaaataatttaaaggtgttatattttatatagtttaaaaggaatataattagtaaaattttataatttagaaaaaaaaatagttgatagtgattgatttataaaagtaaaatattttttgttaatattaatattttttttataaattaattgatgataaaaaattgagtgaatgagatttgtagtttatttatttatgatgttggtttatttaatttttataatttgttgtatttgaaagagtatagtgatagaggttatgataaaatttaggtttagtgttataattaaatttttgtaggaatttttaaggttttgattttatttttgaatgggaataatattttttaagaatattatgaagattaaaaagttatgtattataaatatatatagagtaataatattgggaatattgtaatttgtaagaaagaggaagtatatggtatattttgatggttagggatatggattttgtagttgggatgtttgaaagagaattttgattttattaatggttagttatatgaaattgtgtagataatttaatttttttgagtttgtatttttttttgtttatataatggggataataatagtatttattttatatatagtgttaatttttattagtggtttttattaagatagtattgttgtttatttttggttgttagttattatgtatttgagttagagagttattgattttagaaagttttgaggagattattaggttaagtaatttgttttttgttagataattagttttatttatgagttattaaagagggagttgaaatttagggaagttgaaagagttgttgattgttattttgtgagttggtgatagaaagatatttggaattttagtagttgtttattttttagttttgggttttgtattgtattagaatattgtgttattttaaatatgaaaaggtagtatgattattgtgtttgttattttttattttttagatgttattttatatttgtttttatgaaatttaatttgtgatttttagattatttagaattttggttggatagtgttttttagtgttatttagtatatttttttgttattttttgttgtttttgggtttttttaaaagagttatattttgggtgttaggaaattttatatatgattgtttttttttttttgatttttttttttatttatttttttagtttgtagtaaattagaagatttttttgatatttttttatgtttaaaggttttttgatatttttatatggtggtatgaattatagtgtattttaattggttttttttttgtatgttttttataatgagttgttgaagttttatgaaaatataatttgttttatttagggtagttataattttaattataaagtatattttttggtttttggttaggaatttgattattttttgatgtttttttgtttaggattttttgatttttttttaaaatattttggggtattttttttttttggtttttggaaatatatttttatattgttatgaaggtttttattgatatttttaattttttttaaattgatttagtaaatgtttttttataataaatgttattgatatgttattaatatggagagtaataatagaatgtattgagtaaattttttttttggaggtttgagaatttagattttagtttttatagagttattattttggtgattttggatagtagattttttaagttttagtttttttattttttaagtggggatattaatagaatttatttttagagatgttgttaagattaaaataattaagataatttttgtagatgatttggtatagtgtttgttatgtattaagtaagagttagtttttgttattatagtatgattataaaaaatgaatagattaaatgaagtaattagaaggaaagaaattttaatttttaaaatgtaatagttttttggtttttttttttttgtgaaatatttgtatggtatttttttgttatttatattgttttgattgtggttgttgtagatttttgttgaaagtttgagagattgagatttgttattttgaatatggtattagtggaatagtttatgatttaataattgtattattttggataagtattagtagaagtgagttaggatatgtgataaaaagatatttattttgttttttttttttttttgtattttttttgttataaaattattgatgttaagtttatagtattaatattttagtttaatttataataaaatttgagggtatttgaatatattatttgttgtaaattataattttatatttgattatagagtatttgaagtgggttttttttttttttaaaattttattttaataattaaaaaatatttttaggagaagtattatttaagaataggtttatattaaataatattattttatttttaattttttggtggttaaaaaatatgttaatattaattaggatatgatatatatgttttgttagaatagttttggtagttagaagatttttttttttgtgtttgaaagggatgttatttggggtagttatgagttatgtatttagatgttttgaaaggattagtggtagatgtatttttatttttgtttttttttttttttttttggtattttagttgttgagtgattgatttttgtttttagttttttttataattattattgttttaataattttgtttaaatagaatgtttttttttgttataagttatggggttatttattgttaattttttaaagtattgaaatgagaattttataaattaaagaatatttttgattttgagttagtagattttattaagttttttgtagatggaaattttttttaaattggtttgtttttttttaatattttattattttattgtttattttttggagttgtgatttgtttaatatattttaggttttttaataaattaagttatgtaagttattatttggattattttgaaattataatagtttattaaatttttgaaagaagaattttgtgtttgtttatagattgaagaattgatttagttttattggttgagttatttttattatttatatttaatttttggtattgagggtgggaggagggagaggagtagaaaagatataattattgggtattgggtttaatatttgggtgatgaaataatatgtataataagtttttgtgatatgtgtttatttatttaatgaatttttatatgtatttttaagtttaaaagtttaaaaatatatatttggtaaattaattgatgtgttttaaaaaatattgttttttggttgggtgtggtggtttatgtttgtaattttagtattttgggaggttaagttgggtggattatgaggttaggagtttaagattagtttggttaatatggtgaaattttgtttttattaaaaatataaaaaatagttgggtgtggtggtgtgtatttgtaattttagttatttgggaggttgaggtaggggaatttttttaatttaggaggtggaggttgtagtgagttaagattgtgttattggattttagtttgggtgatagagtgagattttgttttaaaaaaaaaaaaaaaaaaaaaaaattatttttaaagagataattaatttttttttagaaggtagggttaaagtttaaggtttttttaggttttttgtattttttataaattttagagttagtttgttaatttttatatatatataaaaaaagtttgttgggattatgattggtattgtattgaaattaaattaatttgggtataagagattttaatttggggattgagtttatattgagttttttaatttaggaatattgtatatttttttatttagttagatatttagtttattttaataatatttttagatttttagttttttttagtaatatttttttattttttttgtaaagtttttgtatattttttgttttatatttattgtgtatatgtgttttgttagttattaaattatattaatataaattttattttttaattgtttgttgtatatatagaatgttttaaaaatattgtgttttgtgattatgttaaattaattaattttagttattatgtttttattattttttttttgaatttttattgttttttttttttgggattttatttatatgtaaggttatttgatattgttttttaggtttatgaagttttgttaatttttttttatttttttttttttttgtgttttttaattgaatgaatgttattaataatttggtatgtaatggtttatttaaatttttttttgtttttaagatatttttatttttagttgtgtttggaattttttagtttggagttttattaatttttagtttagaaggaaggaggagaaggatagggtgaaaggaaggggagagtttttagttttaggatagagattagaataaataatagagtagttattttggataaggaaattttttttaaatttattatttatatttttagaaataagaaaaataatgtatttattaaattaaaggattttgaaaaagggaatatttagagaataaaattaaatttttgaaagttaaaaggatgataatataaatgaaaagtttagttgaaggattgaaagataaaagtaagaaaatattttagaaataagagtaaaaagatagtaatgtaaaataggggagaagataagagaattagagaattagtttaggagttttagaaagagaaaatgtagataataaaaggtaagaaattattaaagattggagtaggggaggttatgttatttgtttttttttttattttttattttgagttatatttttttttattgtgaaataagtatatgtatatgagaatgaataaaataaatatgtagttatgtattgtttaataatagagataggttttgagaaatgtattattaggtgatgttattattgtgtagatattatagagtgaatttatataaatttgaatggtatgttttatagtatatttggattatatggtatagttgttgtttttaggttataaatttatagtatgttattgtattgaatattgtaggtatttttaatatattggtaagtatttatgtatttaaatatagaaaaggtataataaaaatataatataaaagaggaaaaaaatagtatatttgtataggtgtttattgtgaatagggtttttaggattggaagttgttgtgagttattgagtagtgagtgaatgtgaaggtttaggatatttattatatgaagtttattgtagtgtaaattttgtagatttaggttatattaaatttatagaaaaattttttttaataataaattaattttagtttattgtaatttttttattttgtaaatttttaatttttttaatattttgatttttttttagtaatatttagtttaaaatatatatattgtatagttgtaaagaaaattttatgttttttttttgtaagtttttttttatttttaagatgtttttatttttaaaattgttattaaaaattaatatataaatatatatattaatttaggtttatataaagttagtgttattagtgtttaatttttatatgttattttattggaaggtttttaggggtaataataaatatagagttgttgttttttgtgataatagtgtttttttttgatatatttattgaaagatttggttgagagtgtttgatagttaataaaaaaaaaaaaggataagaagtatattttaaaataatgaaaaaagtataatatagtaaatatataaattattaatatagttatttattattattattgagtattatgtattgtatatagttgtatttgttgtatttttttataattggtagtatggtaggtttgtttatattagtattattataaatataagtatggtgttgtattataatgtatagttgtagttaagtgataggatttttttagttttattataattttatgggattattattataaatgttgtttattattgattgaaatttatgttgtgtatgattatatatataatttaatgaaaaataataataataaagttagtagtgtgtaattattaattagggtaagaaatagaatattgttaatattttggaggtttttagtatgattatataagtttataaattttattttgttttttttttttagaggtaattattgttttgataaatgtgattgttgtttttttgttttttttattatttatataaatatttttaaataatataatttagtttgtatattttgaattttatgttaatagaatattatatgtatatgaattttatgtgaatagaatattatatatgttattttgtattttgttttttttatttaatattgtaggatttatttatgttgtagtgtatagttgttgtttatttattgttgtatagaattatatttttagagataagatatatggatgtttataaattattttattattatgaatatttgattagtttgtagtttttatttaattaaaaaaatgttgttgttaatatttttatatattttattgtatatgtatattaatttatttataagtataaatttttttttgaatatatatttattgatggagttgttatattataggatatttttgtttttgattttattggataatattaaattgttttttaaaatgattatatttttaaatttaggatatattttattgttaaatgtttaatttttgttagtttgatgggtatgtaagttattttattgttgttttaatttgtatttttttgattattaattaagttgagtaattttttatatgtttattggttatttggagtttttgtattgtaaagtataagtttttttgtttatttttttagttttttgtttttttagttgaaatttaaatttgtttaaatttgttattttttgagtataagtaatttgggatgtttttttttagatttagtttaattttttattattttgttagtttgatggtgtttttaaggagatatatatgtgtgtgtgtgtatatatgtgtgtgtgtgtatatatatatatgtatatgtatgtatgtattttttgagatagggttttattttgttatttaggttggagtgtagtggtatagttttggtttattgtagtttttattttttgggtttaagtttttttttgttttagtaatttgagtagttaggattataggtatgttattatatttgttaatttttgtatttaatagaaatagggttttgttatgttgataggttggatttgaattttttatttgaattttttatgttaagtgatttgtttgttttagttttttaaagtgttgggattataggtatgagttattgtgtttggtttggatattttttaaaaatattttttatttagtattttggtttttggtaggtaggttggtatttatagtttgatttattatttttataaaaagaaatttgtaaatgtttttaaatagattttgaattagtttttttgattttgaatttttatttttatttttagtttttgagttttttagaatttttttttataataattaggttgttttttagttttttttattggtgatttaatagattttaggaagttaataatttttgtttatttgttttttgttttgtgaattgttgttggtattgttttttttttttatttttagaggtgtatgtttttaaaaatatatattgggtttgagagggagttgaaataaaagtatgtgttaaatatattatttttaattagaattatatttgattggttattttatttttaagtttatatatattttaaatagagatatggttaaaggaattattatgtgaataatagttagggttttgaatattatagattatattattatatttgaaatatttgaaattttgatttaaaatgagagttttatagttatgtttttaatggattaagtgtttaagtatttaatatttaaaatatttttattaattaagagaagataaatattttaatagagaaataggtaaattttattaatagttagtttattagatttgttttttgttagaagtgaatatggggaaatatatgtgtttatgttttgtttattttttttggagtaggtaaggagaggtagtttaaggatttatgtgataaattttaaagttgtttattggttttttagttttttttaggaatttaatttagggaaataattagatatttgtaaaggtgtgtatagtggtatttataatagtgaaaaattaaagaatgattaataatgggagaatggaagttatagttaaatattttataattattaaagaattatgtaaaatatttattgatataggagttttattaaaatgtgaagtatatagatgaatagtattatatataaaaagtaaggtgtaaattagttatttatattgttatttttaaaataaatagatgtagtttttttaaaagatgtaggttatatatggaagtgtttgttggttttttgttaaaagaatggtgattttattttttaatttaaattttttgttgttttttaaattgtttaaatagttatagtttttataatgtaaaagtattttttaatttagttttatttgataaattatttttttattttatttagttatgtaattttaaatgaatttatagtagtaattttagagtagatgaatttataataataattttagagtagattatggattagatgtaaaaatatgagttgggttttatggttatagagagttttttttagtgtggggattatagttgtattgagtttatttagttttttttttttatatgaatgaaaaatggggttagtttataattggaagggttttggtatgtattattgtattgtgtatgatgtgattttttgatgttagtagggagagaattaaattgttttttatttaaattaagatttataaatagtgttaattagttattttagttattttttgtagtgttaagaaggtgtgaattttttatgttttttattgtatatttttgtttaatttagtgtttttttttttttttaggttttggttttatgttatattttagaaattataataattttttttggtattattttatttttttttgtattgtgagaaaaattaaatttttaagtggatgttttttataaattatttatatttttttgtttttttttgggaggtagggatagggatagagtttttttttaggttaattaagaaaatttattgtttttaatgtaatttaaaagatttttttttttttattgttttttgtatttttaattttttttttttttttttatagtagagataagtgaatatttatttttatgtttttttttttatgtgtattttaagtttttattaaaataaggttttaggattttttagatttaattatgtttttgggtttggttgattgttgtaggagttttagggagttttttataaatgttagagtgatttatttattaatattaaattttaggatatatgtaataaagtaggatttttttttttatggaatgtgttgattttagatgatatagtatttaatgtagaaaatgttggaatttttttttggaattagattgtgatgagaggtgtttgatatgaatataagttattgttttttttttttttttgagatagagttttgtttgttgtttaggttggagtgtaatggtgtgattttagtttattgtaatttttattttttaggtttaagtgatttttttgttttagttttttgagtagttgggattataggtatgtgttattatgtttggttaatttttgtatttttagtagagatggtatttttttatgttggttaggttggttttgaatttttaattttaggtgatttgtttgttttagttttttaaagtgttgggattataggtatgagttattatgattggttagttattgttttttttttgattttttttttttagtttttgaagataaagtaggaaataattttttttgaagatatttgataaaaatttttaaaataataaaatgtatgtttttattttattgataaaaaatttattgtagtttgttatttaagagtatgataatagtaataaaaagtaattttaaaaagttaagatttttttagtaaaatagatgatttatatttttaagttttttttgaaattagttattaatattattttttttttatttttatttgaatgattgtagtaatagttttttgtttgtttgtttgtttgtttgtttgttttttgagatggagttttgttttgttgtttagttggagtgtattggtgtaattttggtttattgtagtttttgttttttgggtttaagtgatttttttgttttagttttttgagtagttgggattataggtatgtgttattatatttagtttatttttgtatttttagtagagatagggttttattatgttggttaggatggttttaattttttgattttatggtttgtttgttttggttttttaaagtgttgggattataggtgtgagttattgtgtttggttagtaatatagtttttagttatttgatatttttaagtttataatttttaggttatgtatagttttatgttttaattaggtatttattgattttagtaggtttttatttatttgtattagttttttttttttttttaattttaaggttatttttaaatattagtaaatgtaaaaagaatttgtaaagtggtaaggtatggtttattaaaagttagtttaagggtagtttttagttttgttttatttgggtttagtttagttgatggatgagttgattgatgtgtttattttgatagttaggtgtgtttatttttttgaggaagtttattttatttttggtagtatgatgggttattgagaggtggaaagggtgtaagaattatgagattttttggaaatgtttttttgggaaggtaattttatgaatgaggttttttaagtaaatgaagttaaatttttttaggtgttttttaattattgtgttgtttgttagagggatggttttatttttgattttggtttgtttatgttttaaaatgagtttttggatagattttagatttggaaatttttaggttatataaggttttattatatgtagtatttttagattttagggggtaatttttataaagatattattaaaaattttttttaggtgaagttttgtagtggttttttgtatttgtaaatttatgttattaatttttttgatgtgtataataaaggttaaggaatgtttatttggtaattttaaggtatgaggttttatttttagttgtttgagatgtattttgttatgtttttgttgttaggaattatgtaggaatgattttagttgtttaaatttgagtttttttttttttttttgttttgttattgttatttttttagtggtgtagttatttaattttttttttaattataatttttattttaagttttagggtatatgtgtaggatgtgtaggttatataggtaaatatgtggttatggtggtttgttgtatttattaatttattaggtattaagtttggtatgtgttagttattttttttaatgttgttttgtttttttatttaatgggttttagttatatttttaatttttatagtttagatgttatgatttatagtgtggtttttatagaaagttatggattaaaaaaaaaaaaaaatatttaaagtgtttgaatttttttaaaataattttggtatagttaaatttatgtattgattgtttatttaatatttaatagtttgtgttgtgatatattgttttaatgttttgaatgtttgttagtttttagtattgaagatgtgaattatttattagtaatgatatatttagtttaaggttgttagttatttatgttataaattaatgatttgtttttaaaatattaattttgtgatttatgttttggtaggtggttagatgttttgtgttttaattttaaattatggataaaggttttgttataattattgttttattggtttttttttttttttgtttattttttaaaaaattttgtaatttttttttgttaaatttttattttaggtttagaggtatatgtgtaggtttgttatataggtaaattttgtgttataggggtttgttgtatagattattttattatttaggaaataaatatagtatttgatggataggtttttagtttttattttttttttatttttaagtaggttttagtgtttgttttttttttttttgtgtttttgtgtatttaatgtttagtttttagttataattgagaagaatatgtggtatttggttttttatttttgtgttagtttgtttaggataatggttgttagttttatttatgttgttgtaaaggatatgattttattttttttattgttgtgtagaattttatggtgtatatgtattatattttttttatgtagttttttgttgatgggtttttaggttgattttatgtttttgttattgtgagtagtattgtagtgaatatatatatgtatgtgtttttatggtagaattatttatatttttttgggtatatatttagtgatgggattgttgggttgaatggtagttttgttttaagttttttgagaaattattaaattgttttttataatggttggattaatttatatttttattaggagtgtataagtatttttttttttttgtaattttattaggatttattattttttgattttttaataatagttgttttgattggtgtgagatggtattttagtattatttattgaatagggagttttttttttattatttgtttttgttgattttgttgaagattggatggttttaagtgtgtggttttatttttgggttttattttgttgtattggtttatgtgtttgttttgtattaatattatgttgttttggttattttagttttgtagtagtttgaagttgggtaatatggtgtttttagttttgtttttttggtttaggattgttttggttatttgtgtttttttttgattttatatgaattttaaaatagtttttttttaattttgtgatgaatgttattggtattttgagagtaatagtattgaatttgttaattgttttgggtagtatggtgattttaataatattgattttttttattttttgtaattttttgttgttgtatttaattatttttatttgtgaagtttttttagggatgattttgttgaaagtgataattttaaaaattatgttggtaattaaaattttaagtaatgatttttatttttagagattttattttttttagattttggagttgttaatagtagtgtttaatttgtagtggtatttagtagtttttgttttttgtatgtagaattgtttatatgaaaatatagttttaaaaatgtttttttatggttgatatttatatttttattttttttgattttttttaagagggatttggtttgttaaaattaatttttgtaatatttttatgaagatataaattttgataaagtttttaaaataagtttgagagaatatagtattgattttatttgtaaatttgatgattattttagaaaaaaggaaaatattatttattattattttgtttataaatgtttattaattttaaagtttttatattgtatattttttattataatagtagttattatttatttttttttaaaaaaagtgttaagtgtgtttttgaaatttttatattgtgtagaatatttttaaaattttaaaataaaaattatattattatttgttttaaatgttttttttttatttaatatatagtttttaaaatgttagtaaatagtattttagaagagatatgttatttttttaatgaatgttttaaaatgaattatagtaatttatatttatttagattgtgaaaaataaaatttatattttattgttaaatttttaaaagtgaaattatatgatagtttatttggtatattattttgttattgtgaattgataaatgtatatgtagataaatatgtgaaaattagagtatatatatattatatgtagtattataatatattttttagtatgttttgattgatatttaattatataatttattaagaggattttattagaatgtagaaaagtattgaattttagaataatttatatatttaaaaaaaatgtagttagtttttttatttgtatttggagaatgtagggtaaaggaataatatatgagtattggtatttaaaaaaaggtgttaattttttatttatgatatttgttattttgggtattatttaatttttatttttgtgaaatagaggagttttaatattttttaattattataatattgttttaatttaatttattttaatttgtgatatagtttgaaaattaagtttttattattggtatgtgtaaaaaaataaagtagtagtagatttggaattttgaatgtaaatttagattttgttttttaataaatgtataatatagtgttttgggattaattttttaatatttttgagttttagtttttgtatttgttaaatgggattagagatatttatttttaggatgtgatatggtttggttttgtgtttttatttaaattttattttgaattgtaatttttatatattgagggagggatttggtgtgaggtgtttggattatggaagtgattttttttatgttgtttttgtgatagtgtgggagattgtaaaatatttgatggtttaaatatggtagttttttttgtgtttttttttttttttgttattatgtaagattttttttgttttttttttgttttttgttatgattgtatgttttttgaggtttttttagttatgtagaattatgagtaaattaaattttttttataaattatttagttttagatattttttatagtagtgtaaaaattgattaatatagagaattggtattggtagggttgggtattgttataaagataatttgaaaatgtggaagtgattttggaattgggtaataggtagtggttagaatagtttggagggtttagaagaaaattggaagatataggaaagtttggaatgttttagagatttgttttgaatatttttgattaaaatgttgatagtgatgtggataatgaagtttaggttgaaatggttttagagatgaggaatttattgggaattggagtaaaggttatttttgttatgttttagtaaaaagattggtagtattttatttttgttttagagaattgatgaattttgagatgatttagggtatttggtagaagaaaatttttaagtagtaaagtattttagtggtgatttggttgattttgaaagtgtttagttatgtgtatttatgaagatatggtttgaaattggaatttaggtttagaagtgaagtagaatataaaggtttggaaaatttgtagtttgattatgtagtagaaaagaaaattttattttttggggaggaatttaagttagttgtagaaatttgaataagtaataaggagtaataagtaataataagtaaaaagtaataagtaataagtaataaggagttaaatgttaataattaagataatggagaaaatgtttttagggtatggtagagatttttggggtagttttttttattataggtttgagaattaggagggaaaaatggttttttgtttagggttttgttgttttgtatagttttatgatatggtgttttgtatttttgatgttttagttttagttgtggttgtaaggggttaagttatagtttgtattattgttttagagggtgtaagttttaagttttggtagtttttatgtggtgttgggtttgtaggtgtgtagaagataagagttgaggtttgggaatttgtgtttatatttaagaggatgtatagaaatgtttggatgtttaggtagaagtttgttatggaggtagagtttttatggagaatttttgttagggtaatgtggaagggaaatatggggttggattttttatatagagtttttattggggtattatttagtggagttgtgagaagagggtttttgttttttaggttttagaaaggtagatttattgatagtttgtagtatatgtttggaaaagttatagaatgttagtttgtgaaagttataggggtattttgttgagttataggggtggagttgtttaagggtatgaaagtttattttttattttagtgtgttttgaatgtgagatatggagttaaaggagattttggagtttttagatttaagggttgtttagttgggttttagattttatggggtttgtggtttttggtttgattagttttttttatttggaataggaatatttatttaatgtttgtttttttattgtattttggaagtaattaatttgtttttgattttataggtttatatgtggaagggatttgttatgttttagatgagattttggttttggatttttgagttaatgttgtaataagattttgggggattgttgtgaaggtataattggttttaaaatgtaaaaagatatgggatttgagagggagtaagtgtaaaataatatggtttggttttgtgtttttatttaaatttaattttgaattgtaatttgtatgttttgggggagggatttggtgggaggtagttggattatgggggggttttttttatgttgtttttgtgatagggagtttttaggagagttgatggtttaaatgtggtagttttttttgtgtttttttttttttttgttgttaggtgagatgtgttttgttttttttgttttttttattatgattataagttttttgaggtttttttagttatgtagaattgtgagttaattaaattttttttttgtataaattatttagttttagatagtatttttatagtagtgttagaatggattaatataggatagtaatgaagattatagaatatgtagatgaagaagtgttaagtaaatagtagttattattatgtagttaaattgaatgtatatattgtggtattttagtgttttttaaattgaataattagaaatttgttggtttttttaatttgtttatattagatgatatgttaatttatgtttatatttttttttagttaatagatataaatttatttatttaatttttattgatagaattggtagtgtggtaagatattttatttttagttaaggttgtataatattaagtttattttatttaaattaattatggtttgggaaatgttttttatgttattatgtatgtttaatttgatattttagtgggatagtatattttagaaaaaaataaatgtttttttaaaaattttagggttgaatatattagttagatatataataatgtattttagagtttttttaagggtaaaaattgtggtatgaatatataaaatatttttatttatatttttgtatttttgaaatgtagtttttatgttaatttagtattttaatgattagtatgatattattttaataatttggaatgttaatatgtttatttaagatttaatatagtaagtatttaaagaaaaaaatggaagtgattgaatgtttttgtattttttaattataatttgtgttttattgtgatatgaaggatagaaggggtaggatagatagaaaatagaaattaattttgatgtttaattttattttaagattgtttgttaagtgatttatataattttaaaaaattttgttaagtttaatggatgttattttgtaggtttttgttaggtaatagttataaggttatgaggtgtatagattttggaattaggtagagttgaatttagatttaggtgttgttttataatgtgattttgggtaaataaaaggtttaatttttgtatttttatttgtaaaatggatttagtaaaaattatttgagataatttatttgtgtattgtatttaggtatgtagtttgatatatagaattataagttagtagtttttagtatgattattattgtgaaagagatattttgttttatttattgaaaattttttttagttttaaattttttatttaattggttgtattgtagatgtttgttatataatttttatataattttaaaaattattttttttttttttgattttttaggggtaaggttattaatgtttttattatttattaaatatagtagtttttattttttatttatggaggataggttttaaaatttttagtgtatgtttgaaattatagattatagataattttaaattttatatgtatattgttttttttatatatatatatttatggttaatgtttaatttattaattaggaagagtaaaagagtaatagtaattaataataaaataaaataattgtaataatattttagtattattatttttgtgttttagggttattattaagtaaaataagggttatttgaatataagtattgtgatattgtggtagtttaattggtaatagagatagtgatgtggtttggttgtgtttttattagaattttaatgtgaattgtattttttagaatttttatgtgttgtgggagggatttagggggagttaattgaattatagggtttggttttttttttgttatttttgtgatagttaataagttttatatgatttgatgggtttattaggggtttttttttttgttttttttttattttttttttgttattattatgtaagaagtattttttgttttttgttatgattttgaggtttttttagttttgtggaattttaagtttaattaaatttttttttgtttttagttttgggtgtgtttttattataagtatgaaaatggattaatatagtaaattggtattagtagagtgggtgttgttgaaaagatatttaaaaatgtggaagtgattttggaattttggaggatttagaagaagatgggaaaatgtgggaaagttaggaattttttagagatatgttgaatggttttgattaatatgttgatagtgatatgaataataagatttaggttgaggtggttttagatggatattaggaattttttgggaattggagtaaaggttattatgttatgttttagtaaaaagattggtagtattttgtttttgttttagagatttgtggaattttgaatttgagagagatgatttagggtatttggtggaagaaatttttaagtagtaaagtatttaaaaggtgattttggtgttgttaaaagtattttgttttaaaagggaaatagtataaaattttagaaaatttgtagtttgataatgtagttgaaaagagaaatttattttttgagaagaaattaaagttggttgtagatatttgtataagtagtaaggagtttaatgttaatttttaagattatggggaaaatgtttttatggttatgttagagatttttatagtagttttttttattataggtttagagatttaggaggaaaaagtggttttgtgggttaggtttatggtttttatgttatgtgtaggttagggattttgtgttttgtgttttagttgttttagttgtggttgaaaggagttaatatagagtttaggttgtgattttagagggtggaggttttaagttttggtagtttttatatggtgttgagtttgtgggtatatagaagttaagaattgaggtttgggaatttttgtttagattttagaagatgtatggaaatatttagatgtttaggtagaagtattattgtagggtagggttgttatggagaatttttgttagggtagtgtagaagggaaatgtgggattggagtttttatatagaatttttattggggtattgtttagtggagttgtgggaagagagttgttattttttagattttagaatggtagatttattaataatttgtattatgtatttggaaaagttatagatatttaatgttagtttgtgaaagtagttgggaggtaggttgtaaagttataggggtggagttgtttaagattatgggaatttattttttgtattagtatgatttggatatgagatttggagttaaaggagattattttggggttttaaaatttgattaatttattggattttagatttgtatgggttttgtaatttttttgttttggttaattttttttatttggaatagttgtatttaatttgtgatatttttttattttttgttttttatttttttggtttttgtatttggaagtaattagtttgtttttgattttataggtttataggtagaagagatttattagttttgttttagatgagattttggattgtggatttttgggttaatattgaaataagttaagattttgggggattattgggaaggtatgattggttttgaaatgtgaggatatgagatttggaggggttaggggtggaatgatatggtttggttgtgtttttattttaattttaatttgaattgtatgttttagaatttttatgtgttgtgggagggatttgggggtgggggtgtagtaattgaattatgggggttggttttttttgtgttatttttatgatagtgaataagattgatgagattttatgggtttattaggggtttttaaaatttttgttttttttttattttttttttgttattattatgtaagaagtattttttattttttgttatgattttgaggtttttttagttatgtggaattgtaagtttaattaaatttttttttttttttagttttaggtatatttttattagtagtgtgaaaataattaatatagatggttagtaagggattaattggtagggagtgtttttagtgtggatatgttggataaagggatgatttatgttttagggtataagattttattatttagaattgtatagaatttaaaatttattaattatttttggaattttttatttaatgtttttaaattgtggttgattgtaggtatttgaaattgttaaaagtgaaattatagataagtggggagttttgtatttaagattatttttttaaattgttttagtggatatgtagggatttgagtgtgaagtgagagtagtagtattaaaatttgagggaaatttagatagtaaaagaaatttgtttagtatattggtatgatagagaaattaaaaagtttttaagttaatgtgagaatttaagaattaaagaattaagtttttgtttttgagggaaggaaaggggtaatgtggttttaaattaggttgagattggttttgagggtttttttttttttttttatattgatatgaatatagatataattgttttgtatttttatttgtttttataaatgtttttttaggatttaggaattgttaattatgtaatatgagatatttgttagtttgaggaatatttgaaaatttggttaaatgatatagattgttatatagttttaagataaatgtttttatttatttgatttagtttggtaatttttatttgggtaaaaatttttatttgtaggttatgattggaggtaggtatagaaaaaaaattgttattttttttgtattatgttattaagatattaaattttagtttataaagtagaaagtgttattttttaagttgaaggtttggatatattttagttttttagttttgatattttattatagtggaaaatgaagaagattgtttaagaatattgatgttggtgttagaaagatttgggtttgaattttgattttattagttatttagattattttaggtaatttaatttttttaaattttgtttttttatttgtaaatgttgaaaatagtatttattttttaggtttgtggagaggattaaatgagataatttatataaagaaagagtttgtataatagtgttaagtaatggtgaggttatatttgtattttgattataattttataaatatttattatgttagttgttttagagtttttttgtaaaatagataaagatagaaagtataaataagaaaaataagtgaatatatattgaattttgtataagatgttggtgatatggagagatttaagatatgggttttatttaaaagagattattgatagaaataggatatatatatattaaaaggtaatataggattatttgtgtaaagtgttatatggtagtgttttaggaagtttagaagttgttatggattaggaatattatggtggatattttaggtagggaaaatagattttagtaaaagttatttttattataggtatttgataaatatttgtagaatttaggatttttgtagtgataaagaaattatatggattatgtaggggagtgataagatatatgattggaaaaataaaaagattaaattatggattatattgagtttgtattataaatagtggaggagttttttagatttttaattatgttgagaaaagagttttagtagtgtgtgggggatagaatggaaagagaagttagtgttagaaggattatttagtattaattattgtagtggttaaagtaagaggtgagagaaggtatgtattagaatggtagtggttagagtggatgggaaggaataggttttgatatagtgttatagggagtaataaataggatgtggaagatgggttagaattggtaaaatttttgtatgtaagtttgggttattaaatatagtgagagaaatttaaatttttttttaagaattgaataaaatatttagaaataagttattgttgtatttgaggtgaatataaatggtattttaaagatgtttgagatattttgttggaaaaagttaataattgtattattgtttttaatatgtttttgttttttttgaagatattatgtttttaattttgaattatgaattatttattatttttgtatgtttttatgtgtgaggaattataaggtgggaataaaatttggtttttattttagaaataattatgtgattaaaaagtttttagtttttttttttattatattggtttttggtattttgtttattatttaatgtattattattgtttttgtttaaaatttgtattttttaatgtaagtttgagtaaatagaattgataatatatagtttgagaagggagtgtttggggttttaagatttattttgtttttttttatttttgatatttggtttgaagagtaaagaaggatatagttgttaggaagtaagttatttaaatatagtgattaaattggattaatttttttaatgagaaagaaatatattatttttgtgagatagattagattttaagtagtatagataatatgattatattttttttataaataaatatataggatttaagaaattttttatagatttaagtgtttttttttttatttttttatttttaaatttattttgtaagatatggttagtttatttggagttaattaaattaagatttttgttttatagatagggaaattaagtttagagatattgagtagtaggttattggtgttttagaggtttgaaaaattttttattgaatatttttttgatttattaatgtataggttttgttgttgtaattttttttttaagaggagtgaatataaatgatgtagagtttggatgaattattttaataagaatttaaagttgaaattaatgtaaattttttttaataaatgtaaagtaaagagaataattagtttttttttggtttgttaaataagataaaatgtgttttgttaaaattatttaatagaaatattgtgaaaggttttttttaaagtatttttttatttgatttgaaaattattttatagtttattattaaataaattagtaattttttagttaatgtagagataaatgggtagttagaaaatataattatttggtgtgtgtagttgagtatttatattttttttaatgaataaagataagaaaagtgtaggtgattttaatgtgtaaaaattattttttagtgttagtgttagagggaaaaagaaattattggtttaagttaattttgtatttgataattaagttgtatagtttatggtttggttttagttttgttttgaatttttttttggatttgttttgaatggattgtttagggttgttttagtagtgtagttgttgtatttttaagtatagtttaggttttaaaatgtttttggttttttttttttttttttttttattttatgttgtttaaagttttatggttaggtttttttatttttagtattattgatatttgaagttggatatttttttgtggtgggggttgttttgtgttttgtaggttggttagtagtattttttgtttttttttatttagatgttaatagtatttttttaattgtgataattaaaagtgtttttagatattgttaaatgttttttagagagtaaaattgttttttgttgagaattattgtgttatggtgtttggataaaaattgataagttaatgggaatattttattggtagttgtaaaaaattaatttagttatagtagttgtatttttggaatttttttttatattaatatttgttttttgaggtgataatatttttgtttttttttttttaaatagattttttgtattatattgaaaaattgttgattaatttatttaaattgaagattaagttaattatgttatttgggtaatagtttattaattttgtttttttttttgttagggaagtttttaatttagtaagtgatattgtatttttttgttaggtatattattatttttattagtaatagggtaattgagattgagaaagattaaaaggttattaagttattatattgtagaattaggttatgaattgtagtttatttggtttagaatttttattttattagtttttataataataatttttttagtgtggtttatggggttttgggagtttttttttaaagggtagattatttttatagtaatatgtattttatttgttattttattatgttagtatttgtaataatggtataaaagtaaagatgagtaaaattgttggtattttagtatatagtagttattgtatttattgttatgtatttaaaatttttgaagaagtaaaaaaattattaattatattaaattttaatttttaaatatatgtggttttttttatgttagtgtgataaaatgagaaggtgtataatttatttatattgtatatagtatttgatagttgttttaaagaaaagtgtataagattaaattgtgagttaatttatttttttttatggagtattatgagagataaattttggtttttagttttgggtatttggtgatgtttttttaaaaatgattgaagtaaatttagtattttaaggaaaataatttaaagtatttgttgttaattgataaaatataggttttaagtaaaaattagaatttttgaagatttgtatttgttattgtgagtttgataaatgtgatttttttatattatataatgaattatgttaatatttgaaagatttgtataatttagtgaattagtattttttagatgattaatgtatgataatataaaattatgtatgggtaaaagatatatttaaagtgtaagatagattgatatattttaatgtaataattaaaagtttattgataatagttttggattttatattgtaatattaaaatttttaaaaaatgaaattgtttaattttggtgtagtaattagaaaaggtaatttataattatttgaatttaagtttttggaggattattaattttttataggtttatggggaagattgtagtatttttttttttttaagattttttagaaaggaagaaggtaatttttgggggtagggtagagatttattgtgtgatgattattaagtatgtaataatgttttatataattttaatatatataatttatataaattttttaaaatggtattaataagggaatggatttaaagaagttaagttagttagttattgttatagttattagagtattggaattaggatttgaatttagatttgtttgtatgtaaagttgattttttttgtaatagtattgagatataagaggtggttataaaatattttggtattttattttagattagagttttaaggtttgttattatttgtagtatgatattggatttttatagtgtttgttttttatttaggtgttaggaaatgtttgtttgaatgaatgggtgtaatttatttgtatattttatatgtttttttaggtgtgtgattaatttataatttatttatgatttttatttataattttttttgtagtaattgttttgtttgtaataaaattaagtagatatatttagttttatgtatggttttttttttttgaattttaatataaatttagttttaggaattatttggtttttattatatttgttattttgattgggaattattagtatttaggtatttatttggaataaggtattttgttttaagggttttttatttaaaagtaagtattttagtaatagtttataatggaattttttaatatttttagaatgtttggtatagttgtgagtgaatatatattgagtaattaataattattatagataatgatgtttttaagattaggatattttagtttttttatttaaagggggtgaaatatgtatttttattatggtatatttttggttttttttgttatgtatttttaataaaagatgttaattttatatggtttttttttgagttttaattattttgttgtattttagtttttttaataatattaaatttgtaattgaatattatttagtatttatttattttttttaatggtgtttattataggttattttattttttttatttgtatgataaaaattggttttttttattgatgtttatggtatatttggtagttttttatgtatttagtttttatttgatgtagtttagaatgattgtttgaagggatgttaaaagtttgattgaggttttaaatttttagttattgtattattaatttatttgtttatttttatttttttttgttatttgtagtttatagttgagtggtttgaatatgttttgtatatattgtaatatttaagaatttgggaatatggttttaggatttagatttaatattattttttatttatataatatttatttataaaatttttagtgtttttgaaaaagaaaaaggaatatgtattgagtgtttgttagaagtaggaatttgtagtagattttttatgtgttattttatttttataatatatatataggtgatattttttttagtttattgatgaggaaatttaggggttaaagtagtagatatttatttaaggtaatagaagttgtgaagtggtatagttgggatttaaaatatgttagttttattgtagataggttttttgatgaattatttgttatggtttgtatgattgtatttaggggtgatgatgttatttttatagggttattgagagttaaaattatgaagtattataaattattatttaaaatataaatatatattatatatgtatatgtgtgtatatataattaatggggtaaatattatagaatattgttttaatttttaaataatgtatttgttttttgtaaattaatatataaataattgtttggtttttaaaaatagatgttaggtgatagagattggttgagtaagaataggagtatttttagaatagaagttagaggagtttttgtttttttaatatattgttgtattatttattgttttaggatttttttatttttttggaaaattttggtttaaagtagtttttttatattagttataagtttttattaattaggggtggtttgtgttggatttatagtagagttattttaggttattttgttataggtttttgatgtgtagttagtttatttgtttaaatttagtagggaatgaatgttttgtaatatggaagtatttataaattttttttaatagtgtttagagaataatgtgaaattttggggtttttttttagaattagggtggtgggaatgttgttttattgattaagtttgttaggtaagtaggtagttggtaagatttaggaagttttatttgaagatagaatttagggtgattgtttggatttattggtttaattatttaaggtaatatttataaaagaaattgttattttattattattattttttaatttttatttttaaatggaatattagtaataaattatattatttgataaatgtaatttttaattagattgataattagaaaaaaattttaagttattttgttttgtgaattagtttaaatatatttgtaattgagatttattattgttattggttgaaataaataaaagtaagagataataaagaataatagagataatgaatatttaatttaagtttatttttaagttttattttttttagagaaaaggtaaattaagaaaagtttagagagaggtattagtatatttatgaatttgtatagatgataagtaaaatggattttaatatgtagaattttagaattaataggttgttagtatttatgtttttgaagatttgtttaagaatataattaaaaatggaatgggtagtttttaattataagtagaaggttataaaattattttagttgtataatatagttttggttttaaagttagtatgtaagaggaaaattttttaggaaaatataatattgaaaattattgtgttatgtaatatgaaatgtaataattaattttttttttagtaatagaaagattattgttttattggtttataaaaatatatttttattattaaatgtggtaaaatgttaagatttggtgaatattggtgaaaagtatatatttattgtataattttttttaattttttttgagattgaaaatttttaaaataataaattattttttaaatagttaataattattagatttgtattttttgtggtgagattatgaaaaatgttagagatttagtaagagaagtagatttatatttttgtttttttttttaagttaaatagttatagagtggagtgggtagaatggaatttatttttgaaagtttagtgttttgtttaattttattgtaagttagataggaaggttatagaaaatgtttttggattagttttttttgagttatatgaaattgtggttttagttaagatgatattaggaattagagatatgggataaaaattttaagattgtaaaaaaattttgattttagtaggaaatatgggtagaattgtaatgatatttgattgaattttaaaagatgtttgtataagattttaaaattaggaaaaaaattatggtttaagtaattaaaggtataggaggtatttttttgggatgatggaaatatttttttttttgattgtgatagtagttatatgaatatttatttaataaaaattataaattatagatttagaaaatagtaaatgttattgtatgtgatattttaataaatgtgattataaaaataaattttaagtatttaaaaaaaaaaaaaaaaagaagaagaagtgaattagaattatattattttattttggagatattttaaaagaaatgattttatttttaattttgtttaaagaagaatataatatgatttgaatatatttagttaggatattttagtgtttgttagtatttgaagttagagtttattgtgagtattttgattatgaagtgagaagttaagagaattgtattttgatatttttttgatagttaaattataatattgtttttttttttttttagttttagtatgagattagatgtaagtttttttttatttagttttttaatagtaataataggattattttttaaattttgtttggtgtgttttgatgaagttttaggatgttattatggagttttaatttgtggaagttgtaaagttttttttaaaagagtagtggaaggtagtgtgtgttttgaagagtttattttttttttatttggtttttattttttagggtggattttgaaatttttattatatgtaaagtttatgaaaggttaaatattagttaagaggggagaggagggtggtttttaggttttttaatgggtaggaaagtatttaaaataataatataaaaagatttagaataaaatagaaaagtataagttgatgtttgggagtttggttagggagtataaggtaatattataagaaagtgttattatatgaaatgatggtgttaagtttgggtataatataatgtttattgtattagaaatatgggttttaatttttataagttaataggttttaaagttattaattttattggtttggtaaaaatgagttatagtgagaattgtgataggaaaaaaaaaagatatttattttattttttatttattttttttttttattaagttagggtattgtgttaagtggtataaatattaataagatttgatttttattttttgggaagttatattttattgaagtgaaagatgagttaataatgataaggtatagagattataatatagatgagggagagagaaatttggtttgaggaggttaggaaaggtattttagagaaattgattttattatataaatgttgtattaatataaattttattttgttatggatttagattgttgatagggtaatagtattatttttttaaagaatgagaaatttattttatagtaaatttattagaagagagtttaaaatgttttaatattattagtgatttttttaggaaaaaaattgttatataatttagttatttttaaagtagtttgaaagtagtttggtttaaagttttgattatattaattttttaaagaaataattatttatttattgtatgaggattattattatttgttttatgttgtgtttgtatatttatgagagttagatgagttatttttttttgttttattttttaatatattagtaaattataaaattatttatattatattataaagattataaggatggtagttttggttagtgtagtagttttatttattgattagagttaaaagtaaagtttagttttgttttgtgtattgtttttaataaagtggatgttatttaatatatatgtagaagatagaagtgtttttgtgtttttattttattttttatttttttaattgtttaagtatttttatgatataaatgtagtgataataataatatggatagtttttgatttaatgattttttaatttttatgatggtgggaaagtgatatgtatttagtatggttttttgatttataatggggttgtttttagataaatttattgtgaattgaaaatattttatatttagtattttatttttaatatttgttagaattatagattattttttaaaattggtatagtataatatgggtattagtaagttgttgtattttatttagagttttatattaggtaggggtgggttttatttttgattttaattaataggtgggattattatattagttaaagttggtatttttgtggtttttgtggagtaatgtgagtagtattataatttatattttttataataaatgatttaagagagtatgtgattaatgtagtagaattattgttttttattatttgattttatatgtaatatgttattatttttgttatattttattggttatatagattaattttggtaaaggatggaaagggattgtataagattatgtatttaaggaggtagagattattgggggttattttgggaggttggttattatatttattataaatagaaaattagaattatttgttaaaaatagattttaattataaaaatgaatattatataaataaaataaagttataaaattttagttgatttgaagatttatttttttattagttagaaagggaatttattaagtagtagaagatataggaattttaaaataagatattttattgttttattagaagggttgataggaaaatgggttgggtattgtggtttaaggaaaatgggttgtgtattgtggtttatatttattattttagtaatttgggaggttaagatgggaggattgtttgaggtttggagtttgagattagtttgagtaatataatgagattttgtttttataggaaaaaaaaaaaaaaaaaaaatgttatttaggtattgtatttgtagttttagttatttaggaagttaaagtaggagatttaggttgtaaagagttatgatatattattgtattttagtttaggtaatgtagtaagaatttgtttaaaaataaataaataaatgagttaaggaatgaatgaatggattgataggaaatgattattagttgtatgtggttatgtgttatgaaatagtgaatattagttaaaattttttattttatagataaggaatagatagatagatttgtttaattttatgttaataattataaagggttatttttaatttatgaaggtatattgtttttgattttatagtttagagttttagttgtgtataagatatatttgggataaagaaattaagattggtgtaatgtgtatattttgatattttagttggatataaataaaattttggaattttttatttttagtagtgggtgatttttttttttttttttttttagtaattgtaggatagtgatttagagattttttatagggtataatttttttgtattataattattttattaatagatgtatttgttgattgtatttttgatttataggggatagaattgggttagtgtttttattttttgtttaagtaaagaagttaggatatttatagagtataaaaagaaattgaaatagttggtatagatatttggtattggagagtagttttgaataaaggtgaattatagtttagtggttaattttgtggtttattttttataaagaattgaatttgatatagttaattatttattttaaattattatttgtttaaaatataatttattggttgggtgtggtggtttatgtttgtaattttagtatattgggaggttgaggtgggtggattatgaggttttgagattgagataattttagttaatatggtgaaattttgtttttattaaaaatataaaaattagttaggtgtggtggtgtgtatttgtaattttagttatttgggagtttgagttaggagaattgtttgaatttgggaggtagaggttgtagtgaggttatgttattatattattatatttttagtttgggtgatagagtgagattttattttaaaaaaataaaaataaaaaaatataatttattaaattgtgtaaaatatagtttattaaaaaagtagttatttttggtgggtattggttggaattgggtagaaagggggtttgttggggtattgttttgttttttgatttgagagttgattatataaaggtttttggtttgtaaaaatttattaaatggtttattgatttgtgtattttttttatatgtgaatattgtaataaggttttttattgtattgtttttagtttgttgaatagaaaaagggagattttttttgttgtttttgattttttgattttataatggtaatgtaggtaagaatatttttttaaggtaatatttgtgggtgttttggttatattttattggaaataaagatagaggttgtttttataaaatatgtttgaagatttgtgaaattttaatagtgttttttattttatataggatagtataattatttatgtgttggaaggaatgattgtattattgataaaatttgaagaaaaaattgtttagtatgttgttattgaaaatgtttttaggttggaatgaatttggaaggtaatataaatatttgaaagtaattgtttgtttttgtagtttataaaaatttattattttatttttgaagatatatgtaagtagatgtaattaatgtagttagtttagtatatatatgtttgattagtataatgttattgtttaataaaaatgggaaattttttttatgaatatgttatattgtttgtttatttattagttttttttatatatattgaatttagtatagttagattatatataaagaaaggaaattatgtaataatgaaatttatataatatgtagtaattttattatttttatttttttttttagttttaaaattattttttagggttggaaatgtttttgtattagatatatttatatgtttatttttttgtttgttttttaaaagtatattttttatttggagatttgtgttttattatagatttttaagtggggggtggtgggaaaaaaaaaattttaaggaagaattggatgggttttgttttggtttttaagtaaagaagaaatttgggttgggtgtagtggtttatgtttgtaatttttgaagtttgtgagaatttttttgtttagtttttatgtgaagatattattttttttattgtaggttttaaagtgttttaaatatttatttgtagattttataaaatgagtgtttgaaaaattgtttaattaaaagaaatgtttaattttatgatttgaatgtatataatagtgagaagtttttgagaaagttttttggtttttttgtattttgggagattaaggtaggtggattatgaggttaagagattaagattattttggttaatatggtgaaattttgtttttgttaaaaatataaaaattagtggagtgtggtggtgttatttgtagttttagttatttaggaggttgaggtaggagaattatttgaatttgggaggtagaggttgtagtgagttgagattatattattgtattttagtttggtgatagagtaagattttgttttggaaaaaaaaaaaaaaaaagaaatttgaaattagttataagttagagttttatatttttgtttatataataagttgtataattaatattgattttagtattaaaaaatttttttttgaaaaaagtttggaattttgttgtggttgaaattgtaagttttgtgaaggtagtggtgattttataatatatatgtttagtatttattgtgaaattagtatttttatttaataaatatgtattaataaggtagttattaggtataaaatgaataaaatagtgtttgtatttaagtagtttatttgttagttaggttgtagagttagttataaaatagtatggtatattatagagggtatagggttataggaataagaggaaggttatttaattttgttttggaagttaaggaagaagtaatattgaattttaaatttataagttgagtaggaattagatagatgaaaaataagggtagagatatgattagatttgtattttataaagattaattttatatggagagattaattaagtgaatatggtagttttttagataagagatggtagtattgagagagaatggaaattatgtggttttttttatgattatgatgattattattattttagagatagagtttaatttttgttatttaggttggagtgtagtgatatgaatatggtttattgtagttttgaatttttagatttaagttatttttttatttagtagggttatggatgtatattattatgtttagttgatttttttttaatttttgttttaattttttgtagagataaaggggttttgttatgtttttaggttggtgtttaatttttggttttaagtgatttttttaatgtggttttttaaagtgttggtattataggtgtgagttattgtaattgatttatgtggtttttttgataggagagattaattgttggtgttatttagtatatattgtgtgtagatattttgttaaatagaaaatagatttatgggtatgattatgaagagtttaattttttaaattatatatataattttatttatgtttgattaggttatttaaatttaattgtagagtgttagtatgttaaatattgatttatataaaatgatagttgtttatttttttgtaaatgttataaaaattgtagagattaattaaaaaatgtatatagaagtttgtttttagttttataagggtagtttatttttgttataaaaatagtattttttatttttttagatattagatttttgtttagattttatttagttttattttgttgttttttaattttttatgtatgtaatatattttgattatttaaatatgtattaagatatttgagtttttagtgttttttggtttattttttttggttttaattatttttaatttttatttttttattttatttattttatattttgaaataggttttgaatgaagtttaaaggataaatttaaataaaattttgttgtatttttaatatattgtggttgtttatttagtaatatttttaggtgtttttttgaatatatataaagtttaagatttttggagttttaagtatataatgtttttttgggtaatttttttttatttaaattatgagggtttttttttattaaaagaaaaaagatatattaattataaagtaatgattttgatggattaggttatgaaatttgtttattttttttttttttttatagtttaatagtaattgtagtgttttttgtttttattgtattagaagatgattttaggtagtgattgatatttgatttttttattaattatattattattgttatttttagttgaattttttgttggatattagaaattttttttatatgaataaaatttaagtatatggttgggtgtggtggtttatgtttgtaattttagtattttgggaggtttaggtaggtggattatgaggttaggagattgagattattttggttaatatggtgaaattttgtttttattaaaaatataaaaaattagttaggtgtggtggtgggtgtttgtagttttagttatttgggaggttgaggtaggagaatggtattagtttaggagttggagtttgtagtgagttaagattgtgttattgtattttagtttgggtgatagagtgagattttgttttaaaaaaaaaaaaaaaaaaaaaaaaaaaaaaaaaaaaaaaatttaagtatataatttaggttgtagttttttaaaatattgtattaaaaataattaattatatgtttttatagttagtataatgtatttagttagtgtagaaattggtatttgttgaaaattattatatgttagtttttgatatatatttttttattttttggattttgattattaaaaatatttttgaatagggttatgatttattttatatttatttttatattatatagtggaagaaaattttgatttgttattttttattatgatatgtattgtgtggtatatattatataaatgatttaattttatttgtagatgaattgaaagaaaggtttaaaaaagtttttagggtttgtgtgtgtggttttattgtaaaattattatttttgtattgaattaattttagtatatataaaatttttatttggtttggtatgtatgtatgttaggaatttttggtagattttaatatttataatatagatgagttatgtgttttatattttttttttaataatttttagaaatatttttttgtttattagagtgttttttttaagttaagtagttttgatgatagttttagaataattttgtttaagtttttttataaatgtaatttaggattttaagtggtgtatttttatatttttgttttatattaagtaaattttaagatttattttaagggagtggtttttattgtttaaagggtttagtatttaagaatagataagatttttaatggtgattttaaatgtttttttttaaaaaatttgtttgttttttttttgaaattaaatgtttttatttattttattttaagatatattgtaattaatttaaagtatggttttatttttagtataaatagttaaatgaagtttagttttgtggtattgttagatttataattaaatattattgaaattaatttttttaagtttaaaaatttaatttagtagttttttttttatttttaatttttattttagattttaggggtatatgtataggtttgttattaagatatattgtgtgatgttggtgtttggagtatgattgaattttttatttaggaagtaagtatagtatttaataggtgttttttaatttgtgtttttttttttttatttttttttttgtattttttagtgtttgtttttatttttatgtttatgtgtatttaatgtttagtttttatttataaatgagaatatggtatttgtttttttgtattagtttatgtaggatattggttgtttgttatatttatgttgttgtaaaggatgtgattttattttttttgtggttatatagtattttatggtatataaatattatattttttttatttagtttattgttgatgggtatttgggttggttttatgtttttgttattgtaaattatgttgtagtgaatatatgggtatatgtgtttttttgatagaatgatttatttttttttgggtatatttttagtaataggattgttaggttgaatggtagttaaatttttaattttttgaagaatttttaaatttttttttatagtggtgttattgtggttttgatttgtatttttttgatgattaataattagtatttttttatatgtttgttggttatatgtatgtttttttttgagaagtgtttgtttatgttttttgtttatttttaatggggttgtttttgtttgttaatttaagttttatataaattttggatattagggttttgttagatgtatagtttgtaaatatttttttttattttgtagattgtgatagttttttttgatttgtagaaattttttagttaggttttattgttaatttttgtttttgttgtagttttttttggggattagttataaatttttttttaaggttaatgttgagaaggttattttttaggtttttttttaggatttttatagtttgaggttttatatttatatttttaatttattttattaatttttatatggtagtaggtaggggtttagttttatttttttgtatatggatagttagttattttagtattattaatggaatagggagttttttttttatggtttatttttattaattttgtgtagattatatggttgtaggtgtgtgtttttatttttggattttattttgtattattgtgtgtggtttttttttattagtattatgttgttttggttattatagtttgtagtatagtttgatttggggtaatgtgatgttgttaattttgttttttttgtttaggattgttttggttatttggggtattttttggttttataggaattttagaatgttttttgttaattttgtgaaaaatgatattgtagtttgataggaatagtgttgaatttataaattgttttgggtagtatgattattttaattatattgattttattagtttatgagtatggaatgttattttatttgtttgtgttatttttgattttttttagtagtgttttgtagttttttttgtaaaaattttaaattaatttagatgtatttttaggtattttattttttttgtgattgttataaatgggattgtatttttgatttggtttttagtttgaatattattggtgtatagaaatgttattgatttttgtatattgattttaaattttgaatttttattaaagttgtttattagttttaggagttttttgatagagtttttagggttttttaggtatagaattataagtgaaaagagattgtttgattatttatttttttatttggaagttttttattttttttttttatttgattgttttgattaggatttttagtattatgttaaattggaatggtgatattgggtatttttgttttattgtattaaggggaatgtttttagtttttgtttatttggtatgatgttggttgttggtttgttatatagggttttttattattttgaggtatgtttttttaatatttagtttggtgaaggtttttattatgaagagatgttggattttattgtaattttttttgtatttattgagatgattattattttttttgttatgtggtgaattatatttattgatttgtatatgttgaatgagttttgtattttagaaataaagtttatttgattgtggtgaattaattttttgatgtgtagttggatttagtttgttagtgttttgttgaagatttttgtatttgtgtttattagggatattggtttgtagttttgttgttgttgttgtttttttattaggttttggtattagaatgatgttttttttgtagaataagttagggatgaggttttttttttagattgtttttttagaatagttttagtaggattagtattagtttttttttgtatatttggtagaatttggttgtgaatttatttggttaagggttttttttaattggtaggttttttattattgatttaattttagaatttgttattggtttgtttagaattttagtttttttttggtttaatttaggtaggttgtgtgtttttatttttatatatatatttattttaaataatggttttatatatatgggggttagttgaaaataaaaatgatatttttatagtaaattttatttgtttttttatttatatatatatatatataaattttagattttttaaagtttttgttttaatttatttattttttttagattgtttattttgtgtgtatagaggtgtttgtaatagtgtgaagattttttttatttttgtggaattttttgtaatgttattttttatattttttattgtgtttatttgggtttttattttttttttttttgttaattttgttagtggtttattaattttgtttatttttttaagtaattaatttttataaattaggttttaagttaattaagatttttttatttttattaagaaggaagtagtgttattatagatttatgaatatttttgtggagtttttgtattgattgttaattaattatatgttttaatgggttaggaatttatataaagttgtattaattaagttgttttaaaatagtgattgtttaattaaatgatttagtttagttaatttttttttgaagatattttgaaaaattaattagtattattttttgttttagttagtatagtatagttgggtttaattgtattttttgagttgtattgaaaaatattagtttttttatttagaattatatataagtagtgagaaattaattataaattgagttatagaaaatgtttttttttaattttttagtttgttatttttttttttttgttttaatgtggagtaaagaaatatgtattttaaattatttaaagttatgattaattgaggttgttaaagtattgttttagtgtattgatttggtatatgtgtgtttttttttatattgttaataaaagtatattttatgattttggattaagattttattgagatatttttggttgtttaaagagtttttttatgtattggtgttttttttttttaaaattttattatttttttattaagttgtgatatttaaatttaaaatattttaaaaatatgtttttttgtaagttgaggtaatgatagttgttatgtggtatttattataatatatgttaggaattgttttaagtattttatatatttaatttttataataattttatgaggtagggattaatattgtttttattttatagaaggggaaatgaagagttagggagtaatttgtatagatatttagttataatatggtagaattaggatttaaatttaaatatgttgattttaggtttttgttttttagttttatattatattgtgtttttaagagagtatggtaaattaattagtatggttttattatgattttgtttttattttgaattattaataaaaatttttgtaatttttagttattttatttagtatagaatataataagaatggaattattttattttaatattgtatattgagatattgtttttattattatatttgttttttatagattatatggtgtgttattttaaggatagaggatttaaaaatgatttttaaaggtgatttatatttatttttttttttgtaaaatggtttgtatttttaataatttagataagtatatttttttgtgatataaattatattttttgtttttttttggaattttgagtattttttttttgagagaataatgtaatttttatttatttagttattaaaataattttaggagtatgaataagtttattaaaaagtttataggatttatgttgtagtttgagtagatggttttatattaagttaaggtaaaagataatttatatataatatgaaaatggttgttttaggtttatagagtaattaatataaattttttttataaaagggaaattttttatttataatttatgtaatgtaaagttttttattttatttttttaaatgtttttagttttatgtagtatttatgttagtatttatgtaaaggtgaaaagtgaattttttttattggtagaattaatattatttttagtatgtaatttgttgttatttttttatttttataagtggttttgaataagtgtaaatagtgtaattttttttattatatatattattatgatttagattaattttaaattatagtttgtaatttgttattttaagtttagattttttttttagtttatagtaagagtaatttgttttatataattaatgaaattgttgtatttagagtgaaagtgagataaaaaaataatttatagaagaatttataaaagttatttatttagattgttttaatatattgttataatattttgtataaggaataattttaatgaagtttttggtttatttgtaggtaaaattaattgggaataggtttttttggattttttgtttttagaaaaaaaaaagttttttttttttttttatgttattttattataattgttaaataaaatattttttttattttaatagttttagaaagtaaaaatattttttgaataaattgtgtagtgtagatttttttattatagtttatttttatgtatttgtttaaatatttatagtttgaaaaataaagaaaaaaataaaaggaatttagtaggttattataggagttttataagaaatttttgaaaattttggtaataaaataatagtttttgtaatgttattataatttatttttattttggtgttattgttggaggttattgaatttgaagtgttatatgtaggatatgatagttttgttttagatttaatttggaggattatgattatgtttaatatgttaggagggtggtaagtgattgtagtagtgaaatgggtaaaggtaatattaggtaagatgtaaaatataaaagagtaattatataaatttttgtgttttttttagtaaaaatattttggtttttatattattgtgagtttatggtttattttgttttttttagttttggggattatgaaggggagagttaggtgaatataggtgatagggagtttataataaaatatttatattattttttgttttttaaattattatgtataggatggtaattttatataggatgatgtaatattagaatttaagttataagatttatttaaaattttttttatattgaagtttggggaaagaaaatgtttttagttaattttatttgtttttttttattgtgttatttttaaaaattaggttgtttgtaagattggtaaatattaagtatgttgattgttaaaatttgtattaaagtagaatgattttaattttttattaaatgaaatgttatatattgaatgtaattttaaagataattttaaataaaagttattttattggaatttggtgtggaatggtagaggttaatgttagtgttagttttgattttaaagatagggaattgataagtttgtgtttatgtaaatagttagggagagagtaagaaagtaatttgattttttgttatttttgttttattaagggggaaagaggtgtgaatagtagggtaaatgttttgtttaatttattgattaatattttaagttaagatttttttttgttttttaaaattaatatataatagttgtatatatttattgtatatatttatatttagggggtatatgtaataatttaataaaagtatataatgtgtaaggattaaattagagtaattgggatatttattattttaaatatttgtttggggaatattttaaatttttttttttagttattttgaaatataaagtaaattattgttaattatagttattttgttgtgttattgaatattaaaatttattttttttaattgtatttttgtatttgttaattatttttgttttatttttattattattattttttttggttattggtaattgttaagttaagaattttggttattttattatttagtttatgtttatttaagtagatagaggtgataaaattggttttttttttttttttttatattaaaagttattaaaaagtatttagggggttgggtgtgatggtttatgtttgtaattttagtattttgggaagtttaggtgggtggattagttgaggttaggagtttgagattagtttggttagtatagtaaaattttatttttattaaaattataaaaattagttgggtatggtggtatgaatttgtatttttagttatttgggaggttggtattgagaattatttgaatttgggaggtggaggttgtagtgagttgagatggtattattgtattttagtttgggtgatagagtaagattttgttttaattaaaaaaaaaaaaaaaaaaaaaaatataagagggtttgtgagttttaaagtgttagatgatagaagaaaattgtgtttatttagtatttaatttttattttttgttaggggtgtttttgttttgatagggttaattgattttattgttttttggtaatttttatagagatgattttttgaagagtgttgttttatatttttattttttttaatttaggttttaggaatttatatttggatgattaaatgattttattgtagtatttttggatgttttttatggtatttgttttggggtggagattatatagataattaagtgtaaatttgttgtgttttgtttttgatttgattattaatgagtaagttgtatgtgtgttattttttttgtatttatagggtatttttaattagttgatgtttttttgattgattgttattgtgataatttaggattgaaataattttattaggtatttaggatttaggtaaattggaaatagagttatgagtgtttggggtaggataagtgtaatgtaaagtaaatgtatatgtggtattattattgttttaggatatgtttgaggatatttaatagtatatttgaggttagtaaagtttgttgtaagtaataaggaattttattgtgatattatttatataattttattttagaaagaaaaaggagtatggtaaaatttatgtggatttagtggggataattgtagatgaggatatttaggttgatggggtgggatatatggatttagatataagaggtatttttttgtatggtaaggtttatttagtgtttgtggtttaagaatatgggaataaatttgttttgtttaattgagagaagattaagtttttaagattttataaattagttatttttttattttttaagtttatttttgtgtttgtgaaatattttaggtgtttatttttttttattttattgtagttgtttttttatttgttttttttttttagtgtaatgtttattatgttggttaatgtttgtttttttaagtatagtttgattgtattatatatttttttagtatatagattgtttttagtatttttttattgattttttagtatatattttgtatgattttagattttttagaatttgattttatttttttttttattgtttttttttatatattttttatttttatttattttttttagtatatttttagatttttggtgtttatattattagatatatagtagagaagttatattttagttatttttattttttattttgtattattattttttgtatttttagtttattgttattagtataatgtaaatagggagtttatatatatatatttttggtttaagaagaataaaaaatgaaggagatttttgtttgtatagaaaatagaagttattttgatttttattgttaaaaagaggattgtttaaattattgtattataatgtaataagattaggtagttggatttaattttaaattaattggtaaatatatttagtttttggggaaattgaagatattattatttattataattttattatgttgtttaaaaaatattatgttggtagtatttgttttttagttattttttaatatgtaatttgaaggtatttaagtggaattaaaagtataaatagatttgtatgaaatattaatttattttggtttataaaattaatttaatttagggtttttattattagggtatttagatttagttttaagtagttatagtaaaatttaattatgttatatatattttttatataaagtgggatttataattttttttttttaatagatttatattagttttatttttattaagggatatgtattttttatttttgtgtttttatgttgttgtttaaaagatgggtagttttttattttttttttttttttttttttttttttttttttgagatgagttttattttgttatttaggtttaagtgtagtggtgtgattttggtttatggtaatttttgtttttagggtttaagtgattttttgttttagttttttgaatagttgggattataggtgtattttattatatttggttaattttttgtatttttagtagagatggggttttgttatattggttaggttggttttgaatttttgattttaagtgatttatttattttggttttttaaagtgttgggattataggtgtgagttattgtatttagttttttattttttttttttagtttattatgtttttatattgttttggtgtttgtgataggtagatattgtatattagaaagtatgtatttaagttttgattttttatagagttgttaaatagttttttatggttgtttttaggttagaatgttgtgggggaaaaaaaaattgttgttgtttttatagttaataagaatgagtttttatttattttattatattataattttgttgaaatttttagttatatgagtataattatgtataagaaattaaaggaaaaaaaggtgttttttagaaaaggagtgttttatttattattaaggattagggaggtgtttttttggtaagagtagattttaaatttgaagagtttttgattattttggtagtatataagttatgtttaatttattttatataaaggaataaattatatatttagtagagaaaaataataatttttttgttgttaagtttaagatgattttttgttagaaatttaaaaaaaaaaaaaaattttgaagtattttaaaagttgtgaattgggtttagttttaggtttttagtgttattttataagttaggaaattttagagatttatttgaaaattataggtatgtaatgattttagaattataagtaagaattggtttagtatttttagtttaaagaatattaaggtatatgtttgttagaggtagattttgagtattagaagtttagaattaagttttaggttttgttttttgtataattgtgaatagtgttatatatttttgtttttaggatggattgttgtgaaaaaatttatttttaaaaattaagtgtgtaggatttaaaattgttgtttaattgattgtatttaaatgataaattttgatttaaatgagtaattagtaataagttttataagaattttaatattttaattaaataataaaataatatatggtatgtatgatagaaaataatatttttattgttatattagattatttattagtttatttaaatagttaagatgtaggaagtttaaggaaagttttttaaaattttgattttatagggaattagtaataatattattgtagtagttgtttttttttatgagtttatagttttgtaaaataaaataaaaatgtgttttttggggggaagtagtagtatttttaattaatattttgttatttattttttataggtagagaatgattttattttgtatgtatgattaatgtaaatatatgttgtatgttttttttgagttatataggttttaggtattttatgaagagtatttttgtatgaaaattttattgtttttttttttaggttggtagaatatttttttattttatgttaaaagtatgaaatatgaaggtttagaaataaaggttaatttatatatatagtattaataattatattaagtttattattattttttattagttagatgatttttatgaatgtaaaatattagaaaggtatagtaagtgatattaagattaataagataaataggtatggtagaaatagagaggtatatgagttgtatagggatttttgttgataagaatttgtgtagattttttttttttttttttttttgatttttgattatgggaagatatggaaaaagaaagttaattatagtgattttgtttattatattgttatttggttaaaaattttagttttttaatgagtattagtatgtatgagaaattatgggagaaaaaggtgtattttagaaaaggtgtgtttaattattattggggattggttaatatagtatgggagttggattgttagagatttattatttagaaaatggtaataagagtttataaaatgaatttttgtgagattattttttagttagtaaagataaagatgttttttagtaggtgaagtgataaattatgatatatttagatgatggaatattattgaggattaaaaagaaataagttgttaagttatgaaaatatatggagggatgttaaatgtatattattaagtgaaaaaagttaatttgaaagggttatatattgtgtgattttaattatataatattttataaaaggtaaaattgtgaagatagtaaaaaaaaattagtggttgttagggtttagaaggaagggagggataaatgtgtagagtatagaggatttttagggtagtgaaaatattttgtatgatattataatggtggaaatatgttattatatatttatttaaatttaaagaatgtttattattaagagtgaatttttaattatggattttgggtgatgatgtgtgggataggaggtatatgaaaaatttttgtattttttttttaattttgttgtgaatttaaaattgttttaaaaaaagttttttttaaaaaaagttttatgaattagttggtattataaattttaggttattttaagtaaaaattatatattaatgtttattaaatattgagttaatagttgaatattttttttatatataaataagtatatttgtaattttttaaaaagttttaattttattagtaattgtggttttatagttgttaaataattgtaagttatggatgttgtataagattgtgattttatttaattattttatatttatttaaatatttttaaagtgtatatttattttaatgtttttatattatttttgtttaataaaaagttattttatgttaatggatataagaagtattaataatattttagttaaggtaagagaatttgataaagattattgttagagatgtttaatgttatttgtagtggtatatttgttaaagaagtgattaagtagttatataaaattttgattatagttttgattgatattatgaaggtataatttagtgtttggatattaataattttatttgtttaaaaaaaaaaaaaaaagaatggttttaattgtatatattttagattaattgagttatatgattttttttattgtaaataatattatgagttttttttgttaaaaaataatagaattataaggatggaaatatatattttaagatatagatttttattatgatagattattggaataggtatataattttttattaaaaatgttagattaaaaaaattaagaattaagtgaaggtaggaatttatagagataagtggaatttaagttaatttgttttttgatggtatttgtagaatttggtaaattagtaagtttagtaagttggggtttttttaagtttataattttttttaaaatgattttaataggtttttggggaataggtagtggtaggttatatgaataagttttttagtggtgatttttgggattttggtgtatttattatttgagtagtgtatattgtatttaatgtgtagttttttattttttattttttttttaattttagtttataaagtttataatattatttttatgtttttgtatttttatagtttagtttttatttagaagtgagaatatgtaatatttggttttttatttttgggttattttatttataataatggtttttagttttatttaggttgttgtaaatgttattattttgtttttttttgtggttgagtagtattttatggtatatatatattatattttttttatttatttgttgattgatgggtatttggattggttttgtatatttagtaagtttaaaaataagggatggaaatataaatgtagttgaaaaggtagtggatggatttaaaagtagaagaatataattgtttttaatgattgtgtatatgtttgtgtatataaattataagggaaatttgtaggtattgaaaattataataggaaaatggtaataaagttatagaaattggaaaagtaatgattttttttagattttttagagaatggaggttataggataaattattattttaaaatttagaagaatagataaatatagagaaatagttaagattagtttattgggaaaagatgttattgaagttaggaagattatggtaatttgggaaaagatgttattgaagttaggaagattatggtaattttgatgaattgttggaggttgagtgaggattagttttagagttaaaaatttttagggatttagttttagtgggggttttttgtaattttttgggtttattttataaaatttttaatttttagaaattttataaggtttttatggtgaagatgtaagaaaaatttttttttttttttggtaggagtagagggaaggtaaaatttggaaatatgtagtagagtgtttataataaaaggtttgttttgtaaggaaaattaatttaataggtttttatgtgatttgggggaaaggtaaatagaggattttagtttttttttagtttttttgttttatttttgaaagttatagtttagggatttagatttattaaaaaaaattgagatttaattataaagattaaaaaataatttttttttttttttttaatattttattattatataaatagggttttaggataaaataatagtggattataattgagagagttgtaagatataagttgtttaaggagtttttaggaaatttaaaaataatagaagaaaaagtaaataaaaataaggaaattagaggaaattgaagtttttagtatttataattatggtaaatattaaatatagtttagtttttagttagattagtatgaaattttatattaaaagtttaattattttagttttgatatattaattatgtttagtttttagtaaaaaaattataaggtatgttaaaaggtaagaaaaatttatggtttgaagagataaaataagtattagaagtagtttttagatatgatataaatattttaattattagatagggaatttataatatttatgattagtaggttaaaggttttaatggaaaaaagtagataatatgtaagaagtgatgtatgtagagagatggaaattttaaaaataaatgttaaggaatgttgtaaggaaatgtagaatgatgttgatgggtttattagtagattgagtatagttaagtaaagagttagtgagtttgaagatagataggttaaaggaaatttttttaaatttaaatgtaatataaatatagtagatattaatttagttgtattagtaattattttaaatttgaatgttttaagtatattaattagttatttttttaattaggaggtgaaaataaagtttgttattagatgtttattaaaaaattattagaggatatattttagttaggtgtggtggtttatattggtaattttaatattttgggaggttgaggtaggtagattatagagttaagagattaagattattttggtttatgtggtaaaattttatttttattagaaatataaaatttagttgggggtggtggtgtgtgtttgtagttttagttatttaggaggttgaggtaggagaattatttgaatttgggatgtagaggttgtagagagttaagatagtattattgtattttagtttagtgatagagggagattttattttagaaaaaaaataataaaagtaattttatttttaagaaggattgaagaataataaaagtggtaaataatatagatatatttaaattgatatttattatgtatataaaataataatagtaataatttttttgagggttaaaaagtagaattaaagtaagttttaaggatgataattagaaatagggtatgtagggtatgtaaagtattaaattattgggggaagagaatatttaagaaaaataatttaaaagaatgaaagatatgagaggagggagaaaaaaatgtataaataagggtatgataataggaagtaatagataaggtatattagtatagttaaatttaaatatattagtagtttagttttattaaatatagagatggggttaggtgtagtggtttatatttataattttagtattttgggaggttgtgggtagattatttgaggttaggagtttgagattagtttgattaatatggtgaaattttgattttattaaaattataaaaagttgggtgtggtggtgtatgtttgttattttagttatttgggaggttgaggtataagaattatttgaatttgggagatggaggttgtagtgagttaagattgtgttatttttttttaaattgggtgatagagggatattgttttaaaaataaaataaatgtagagatggattgaatgttttaagttaatttgataggattttagaaataatttaaatttatgttatttaaaaaaagttatatttgaataaagatattgaaaggttgaagtaaaaggatttattttgtatagtataatttaagatatggttaattttttttgtaaagggttagatggtaaatgttgttagttttgtatagtttttgttatagttattaaattttgtttttgtggtaggaatatagttattgatggtatttaaatagaataggtatggttgtgttttaataaaattttatttataaatataggttgtaagtaggatttggtttataggttaaagtttgttggtttttatattgattaaaataaaattgaaggagttatattattattaagtaaaatagatgttaaggtaaaatattttttaaagtatttgtttaggaaaaataattgtaaatatatagttttaaattatataatataaaaatttatagaataagaatatttagataaatttagtaaaaataatgagattttattatattttttttataaattaagtagataaaaaaataaggatatggatgtatattttattttttttgggttaatattgaggtgtgagattattgggatataggttgagtgtgtgtttaaatttatttttaaaattgttaaatttttttgtaattgttaatatttattagaaatgtatgagattttttaagatttattttatattttttttagtatttggtattgttagttttttttattgtaggtatattgatgattaaaaatattaagtatttttttatgggtttattggttatttatattttttatttggtattgtgttttttttaattttttgtttattttttaattgggttttaagaattgtttaaatatttttaatgtggttttttgttaaatatatgttttgtatgttttttttaagtggattatatttatagtttttttaaaaaaatgtagagatgagtaaaagtgtataattttgaagaaagttttgtgtttttgtttattaagaaagttttgtttaatttagggttaaaaagattttttattatttgtttttttatagaaattttgtagttttagtttatatgtttaagtatatgatgtaaggtaagggataaggtttatttttttttttaaaatttatatttggttgttttagaatttgatttttttttttttattgagttatttggtaattttgtagaaaattagttgtttgtatatgtgtgggtttatttttagatttttttttttatttaatgatttgtattttttatttaatgatttgtatgtttatatttatattgataatattttgttttgattattgttgtattatagtaaattttgaaatttggtaatatgaattttttaaatttgttgtttttttttaaattgttgttttggatattttagtttttttgtatttttatttttttttttttttttttttttgagatggagttttattattgttgtttaggttggagtgtagtggtatgattttggtttattgtagttttagtttttttagtagtgggattgtaggtatttattattatgtttggttaatttttgtatttttagtagagatggggttttgttatgttggttaggttggttttaaattttgattttaggtgatttatttattttggttttttaaagtgttgggattataggtatgagttattgtgtttggttttttatgtattttttaattagtttgataatttttattaaaaagttttttggggttgggtgtggtagtttatgtttgtaattttattattttgagaggttaaggtaggtagattgtttaagtttaggagtttgagattagtttgggtaaaatgttgaaattttgttattatataaaatagaaaaaattagttaggtatggtagtttgtgtttgtagttttagttatttaggaggttgaggagggaggttaaggttgtagtgagttatgattatgttagtgtattttagtttgggtaatagagtgagattttgttttaaaaatatagtttgatagaatttttattaggatagttttgaatttatagatttatttgaaaataattaatattttaaatttttaatttttggttgggtgttatggtttatgtttgtaattttagtatgttgggaggttgaggtgggtagattattaagttaggagtttgagattagtttgattaatatggtgaaattttgtttttattaaaaatataaaaaaattagttaggtgtggtggtatatgtttgtagttttagttatttaggaggttgaggtaggagaattgtttgaatttgggaggtagaggttgtagtaagttgagattgtgttattgtattttagtttgggtaatagagtgaggttttgtttttaaaaaaaaaaaaaaaaattttagttgttgagaaagaataggaattttagttttggaggagtggggagattattaaattttttttttaaaaatattattaaaatattattgagtagagtatagttttataaatagttttttgtaaagagatttatagtatatatttgtttttgtaggttatatagtttttgttgtaattttttaattttatagttataataggaaagtagttatatatagtatgtgaatgtttgtgttttaatataaatttatttgtaaaattaggaaaatggtttgaaatggtttaagatttagttttttgattagattatggtatataattttttttatatatattttgaatttggtttgttaatattttgttgattatttttatatttttttttatgaaggatgttgatttataattttttttttttgtgatatttttttttggttttgttattagggtagtattagttttttaaaatgagttgagaagtattttttgtttttttaaagagtttatagagtattgattttatttattttttaaatatttgatatatgttattagtgaagttatttgggtttgtgtttttttttagggaagatttttaattatttgtttatttgttatatagatttatttagaatttatatttttttttgatatagttttgtaatttgtgtgtttttatgaaatgagttattttgtttgagttgtttaatttgggtataaagttgtttgtaattttttaagttttgtaggatttatagaggtgttttttttattatagatttttataatttgtgtttgattattttttttttatggttagtttagttaaaaatttattaattttgttggtttttataaagaattaatttttagttttattgaaatttttagttttattgattttttttttttgttttttatgttattgattattatttttttttttttgtttgttttttatttaatttgtttttttttttttagtttaaggtagaagtttttattgttagttgaagattttatttttttatatagatgtttaaagttatatattttttgtatatttttatttattttattttttaatgttttttatgattttttttattgatttatgtgtattgtttaatttttatatatttggggattttttatatttttttttatttatttttaatttaattttattgaggtaggaggtatattgaaggattttaatattgaatgattttaataagttttttgagatttttttaggtatttgtatatggtttattttgagtgttttatgagtgtttgaaaaaaaatttattgtgtttttgttaagtagagttttatgaatgttagttaggttaagttgattgatagattaatttaagttttttgtatttttgttgattttttgtttagttgttttagattttataattttgtttatatttttgttagagtttggtatggtttttttattattgttattttagagagtatgtagttgatttttgtgatttgttatgtatttaatgattgtttatgtttatagtagtattatttataatagtaaaaaaaatttttattatatgtttttgtgttttaagattatatattttttgtttttagttattaatatggtataatggtataatatattgtttaatttttgagtaattgattagttttttattttggggataaattttatttggttatgatatagtattttttttatatatagttgaatttattgtattaaaattttggtatttttgtatttaaatttatgagggatatattttatagttttggtgttatgataatatggtattattttttttttaaatgtttggtaaaatttagtagtgaagttgttttggtttgtttggagttttttttgtagaaaggtttttaagtataagtttattaaatgtttattgataatatgtttatttttgagtgagttttgttggtttatatttttgaaggaatttaattgttttttttaaatgttgaatttattggtataaagttaagttatttataatatttttataatatttttttaatggttttagtatttttagtgttatttttttttatttttgatattggtatttaatatatttttgttttttttttttttttttaattagtttggttaaaagttttttagttttattaatgtttttatagaattagtttggttttgattttgttgttgtttatgtatgtttttagttatttgtttttattttttattttttttattttttttgtgtttagggtagaagtatatataattaattgagattttttttttttaattaaagtttttaatgttgtaaattttttaagtattgtttttattgtattttatatattttgatatgttgtgtttttagtattagagatttttaattttatgatattttatttaattatgatgttttatttaatttatagtttattaaatgttaaattttaaatatttgggtttttttttagatatgtttgttattgatttttattttaattttatttttgttagatagtatttattgtatgatttaatttttttaaatgtatttagatttgttttatgttttagattaatgttttgtgtatatttgaaaagaatgtaagtttttgggtagattgttttagaaatgttagttaaatttaagttttgtttatttttattgattttgagataaaggtgtttataatgttagatttgtttgttatatttttgatattgttaaatatttttttggaggtaaaattttttttttttttttgagaattattgatttatgtagttttttttttgggattaatttagttttgtttttgagatgtggtttttaggtttttattgaatgtttggtatatttaattagattttttttttttttatggttttaagggattttattttaagtatgtataaatttttatttagttgaagattgtatagatttttggaggtttttttttgtgtattttttttgtttttagtagtttgatttataaattgtatagatttttggaggtttttttttgtgtattttttttgtttttagtagtttgatttataaattgtatagatttttggaggtttttttttgtgtattttttttgtttttagtagtttgatttataaattaaagttgttttagtttttttaaattttaatttttttttttttaatttagtaagattgttagattttgggttttttttttttttattgtagtatgataattatttttaagtataaaggtttagaattaagattttttatttttgggttaggtatggtttattgtatttgtttttttttttttagggattataattatgtattgtttgttgtttagttttttagtaggaggggaattttaggttgtatttattttttgtagttaaaagaggaagtaatgttagtgattttaatattaaaatattaaaaaaaaatttaagatggatgaaatttttttatatgtatattgaattgggttttattatagttatttttagaattaggattaattggtagggaaaaaaattatatggtagggaaaaaaattataagttattgttgttttataattttgtaataattagattttttgtagtatagtaatgtgtaaaattaatttattgttaatatagaatgttgttattatttttgattaagtggtttttatttttatgttaatattgatgttttgtaatgttttatggaattaaatatttttatatatatttattagtttaattttaattataatttaatgaaaaagagtaggaaagatgtttaaggaggttatatttaagtttatatggtaagtaagaaataagattatttggttgggtatggtgatttattgtttgaaattttagtattttgggaggttaaggtgagtggaattgtttgaatttgggaggtggaagtggtagtgagttgagattatgttaatgtattttagtttaggtaatatagtaagattttgttttgggaaaaaaataataataataagatttttagaagtttttaaatttatagttttttttttatattagtattttttaaaaatgttagtagtagtgaagttttagtttgggaaataatgtattttttttttttggagagtgtatagttatatttttaagaagtattgaaatttagaagtttgtttaatatgtattaaatatttagttttttttaaattttgattattaaattttttgttttgttttaattatagttaatatagaattagtgtttttaggagtatattgtgaaaaatgtagtattttataaaagttttaatttttataggattaagtgaaattatgattaattttttgttttttgtttttattagtattattttttgaagagtaatgtatttttttaaaatttttatattagttttattaattagaatttatgtatataaggaaggatagatatttgttttttattaagatatatttattagttatattaaaaaaagtattgtatgttgattttaaagttataattaattggtgatattatagatattttaagatataattgttggaataaatattgttgttgaagttttttatttattttagtattagaattaaatttaagtgtagaatggtagataaagttaattaaaaattattgtattattttatttggttttttaaatagttttgtgagttaaggaggagaaggtgtattattattatttttattttatagatgagaaattaagtgatttatttaaggttaagttttttaattttttgttattttgtatttttttttggttgtagtttaattaataattttaagaaaatgtttatattttagagtgtagtaagagtatataaataatgttaaatgtttattttgtatgtataaaaagttatagtaagaaatttggttgggaatggtggtttatatttgtaattttggtattttgggaggttgaggtaggaggattgtttgagtttaggagtttaagattagtttgggtaatatagggagattttgtttttataaaaaaatttagttagatatagtggtttgtgttttagttatttaggaggttgaggtgggaggattatttgagttaaggaggttaaggttttagtgagttatgattatgttatttagatatggtggtttgtgtttatagttttagttatttaggaggttgaggtgggaggattatttgagttaaggaggttaaggttttagtgagttatgattatgttattgtattttagtttggatgatatagtgagattttatttattttaaaaaaaaaaaaaaaagaaaagaaaagaaaaagaaaattttttaattgattttattttaattttttagtttttaaggatggtttgaagagttaagagttatttgatgaaattagaatgatttatattaaagagttaggaaaagttattgttaagagggaaggaaattttagttagaattggtagtggttttattaattgataaaatttttggattttatgtatgaagtaagtgttaaatataaagttaaatataagagttttttgggataaagtatgttttgattagtgaatataattatatattagtagtgtttttatttttgtttttagtttgtggatgttggtgatagtttgagtttaatttatgaattttagttttgtagatattttttttaaggttaattatgaaatatttttttatttagttatgtgtatataaaattattatgttattatagaatttagtaatattgtttttaaaaagtatgattaatttattaaattagaataatgtattttttatatattatggtattatagtgatttatgaaataattttatataattttatatataattaaagaaatataaaatgtgttttgtatggaagtgtttattttttatttggggaattttagtgagattggtatattttaggttagataatttttttaaaatagaggataataaatatgagatgtttttattgattaatttggaagtttgattattattatatttttttttgtaggtggttgaaaatttttttaattattgtttttaaatatttttggataagattatgagtattgaattttttgagatgttagttgaaattattattaattagatattaaaatatttaaatggaaatattaaaaaatttttgttttattaaaagtgattgttttaataagaatggttgttttaaagaaagttgaattaatagtttttattgtataaattattagtttgttttgtagaggttttgttgttttattttttattgtttttatttgttgttttgttttaaatatgtattatatgtggtttatagagggttaagatttggtaatagaagtagttgagttgttattattttttagtgatgggagagtagatggtgaaatttattagttaatatattttagaaattagaaattttaatatgtggatgtaatttttatagttaaagaaggatggtatttaaattattagtgtttaaagtttgtgtgatgaattttttttttatatttttttttatagttggttggatgaaattttttagattttttgttggtgtattttttttttgtatagttaggatagtatttttgatttatgtatggaaatttgaaaaaaagtttataagtgtatattagaaaagggaagttgtgttttttatagttattattgtttggttttaataattttttttatatttagtgaattatgtttgtttatttttttttatataattttttatttaagttattgtatagttgtttaagatgggtagttagtttgtagtttttttaaataaattttaaatattaattaattatttgtgtgaaaatgggttggtgtttttaatttgatggtatttagttattagaagattataaaaattgatttaaatttttagtatttttgttaaaaaaaaaaaaaaaaaagtttatattttgtatatatttgttttagtggagaattatataggttgtgtaaattaatagttttaattggtatagagtatttagtttagtgatttgttgggtaaattgtggatgatggttgtaaaagattaatttaaaaaataattattaagaggttttgtttgtatttaatgttttatttttgtaatggttatatggtaagaaagttggtaaattatttgttttttaggattttttgaagtagtttgtataattttttaaaagttgtgattttagataattagttgtaatatagttgagagatttttaattagataaagtaattttttttattaaattttatttaaaaattaaatttttaatatggtaaaaatggttagatatttatttttatatttttatttgttattaattggttaattttttttgatggtataggaaagtttagttattgatttttgtgatttagaattgtatgttagatatttatgtttgtaaaattatatatttttaatgtgtgttatagagtttaatataagttttgtgaatttttttattgttgaaaattattttaaataaaatagaagttgtagtagttttttttgtgtgtattttattaattttttgtaaatttaaaatttaatatatttattaagttataagaaatttgatttttatttaaggtggttaaattatttgtgtaatagaaaattgaaaatttaatattaaaaatatggaatttttaatatatttttatatttagttatagttttagatatatattatattggtatttattaatttgggaagggaagggttattgtagttttatatgtaatttattaaaatgattgtaaaatagtttgtatagtgtaaaataagaatgatttttagatgagattgttttattatgatatgttatatattttttgtaggggttaaagaaatgttgatggataatttatatgatttatagtttgtatatgtatttatataggtagtgatggttttagaaattaaatagtttgttttaggggaagagggagatggagattggttttgtgtgtagtgaaggttgttgaggttttgatttagtgagattatagaggaagttattttttgttttttattttgattattttttttattttaatagtgagtttgttagtgtaggtttagtttatttaatttttttttgtattaaagtatgtaaagtatgtaaataggagataggaaggtggtgtttatatttttaaaggtattatttaatagtgggttatttttatatatagtttttttttagtagttgaatgataatagaagttttagaagtttggtaatagtttgtatagaggtattagtaatatgtaaatagtgtagaattttataggttgttaataatatattaatttttttttattttataataagagtttatttttaaataaaatgaggatatgtttttgttttttttgaatgttttttgaatgttatttgttatttttagtattttggagaaattatttaataaaaaaataattatttgttttttgaatgttttttaaaagggaatgtaatattttaagatggtgtgtaatttggttggataaatttttggtgtttaagaaaattgtttgaatatttttattaatgatagtgttaagttttaaaaagagtttttaaaatgtagattattatttttttatagaatgttatgtggttaaaattagaaagtatattttatatattaatttgatttttattttaataattttggtgtttaaaaaatagaatttaatgagaaaaagaagattatgtgtattttgttgttaataataagttaattgatgtttattgataattataggaggttttttattaaatgggaaaagaagttgtgtttttttaggatatgtgggggaaaagaaagttattttaattatgtttaattgtggatttaagtgttatatggtggtgttgtttgaaagtagatttattttttatgtatgtgttatttggttattttaatttaaattgttgaagtttgtagtaattttagtgagagttggttatttataataaattttgaaaagtatttttagtgtttgtaggtattttgtgggatattatataagtagaattgaggtatttaggatataatatttttggggtatatatatttaaatgtttaaaattatgggaggaaattttggttattttaaaaggaaaattaatatgatttgtgtttatgaagtgttggataattagtatgggatgagttttgggtatgttatgaaggaaagttatgttttttttagaatttagaggtagggagtaattttagttttatttaagttttataattttagtttttttttaaaaattttgaaaattatattattatggaatgaaaaatattgttatataatatattgatttgttaaatttttagaattatggtagtttttagtgagatttttattttggttggttattttttgattgtagttgtaggtgaatgtgtttttgtgtgtgtgtgtttggttttagtgttagaagggaaataaaagtgtaaggaggatattttaaattttttgggtggagttttgtaattttttagattatttttaagtaatttggtttatttaggattagtgattaggtttttaggaaaggatttgtttttttttagaaaatgtttgaaaggattttattttttgatgaaaggttgtatgaaaatattttttttaaataatttgtttaattatatatagatttaagtgtgttaatattttattttgtatattaaatgttatataatggggataaatttatattatattgtgtatggtattattaagaagtttttttattattttttattatagtaattttaaaatgtgtaaaaattaaaattagtgatttttgtttaaaaataaaagttgtagttttttatttatgttgaataataatttgtagttaaaaaaaaagtgtttttttatttatgtagtgaaatgttagattgtaaaattttgtgtggaaatgtttaatttttatttttttatttaaatttgttgttttggtattattaaattatatatttgtattgaattggtagtaaatgttagttatttatagtaatgttaaatatggagaaatattataataaaaaaatttgtttttttattatgtgattttaatatgtttttgtagaatttgtatagttttgattgtttaatttgatttttgtttattgaaagtagagttatttttgttttaggaattttaagataatatggtgggtatttaaatgttagtgtggtaatgtttgtttgttaatatggtatagatttaaaataagtttaattttggtgttaaagatttgaaga

SEQ ID NO: 250 - DNA, 67667 bp, Artificial Sequence
  Chemically-Treated DNA
ataggagtaggttttattggttgttttgtggttagggtggtttttgtggttatttttgaagaagttggaagtaaggagatgaaggtgttgggtgtttttgtttttgttttttttgggtaatagtaggaggtttttatttttttttttattttattttatttttatgtatagttttagaaattgggtattggattttttttatatattttagagttatattattgtaataaattagttaaaattttattttatagttaaatagtatagaagatagtttattgtataagtaagttgtgtgttaaaaataaatattaagtaaatgatagtgtaaagtagtttttatttagttttatttttttgttagttttgggatggttttatattagatgagtgtagtaggtgttatattttagtatgataatatgttataaaagattggtatttattattgataggtttatagtaatattatattaaaatgtttttttttttttgtgttttttatattagtgtgtttgtttagtataattttaatgtagttttgtaaataaggatttatttttattagtttaggttgtttgtatttattttgggttttatagatttagtatggttgttgttattttttgttaggggatgggggatggggtaggaagagtaatttatttattatttttgtttttttaggattaggaagggttagtaatttgggatgagattataaagtgttgggtattgggaatttaaaggtgttttttatgttgatttgggattagttataattagagaataggagggaagaaattataaggataatggatttatagttgttttttaagaaggtatggagaggttttttgggtgtagggagttagtaattattttgaggagatggagattgtttttttagtgaggataggttaagagaaattgtagtaggagggaatggaataggattattagaaggattgtttaatttgttagtgtgtttttggtgtatggttttggttgttgtgataggttgggtggggatagtgtttttatagagataattaatgaagagtattttgtagggtagatttttgtatttatagaggttgaggtagaaagttaaaatattgtatgttgttagtttttatgagtttttttatgttttttttaagtttttttagggttagagaattttgatgtgagaatttatgtagtttggtttttgggtaagtgtttatttttttattttgtaaaatttaggggtaagattttattttggaatgtagtgtagttgagttgtggttggagagttttttatagtgtttttgttttgttatgtatagttagtattttttattttttatattttgtttatttttgtttagttttttggatagatgttttagagttatagaggagagatgtttagtgttttattagtgttttttttgtttttttaggggagtttgtggtgtaggttggtgggatgttgtttgatggggagtgtagttttttgagaaagtattgagattttaataattttatatttttaggaggtagttgggggtttgtgggggggagagggggtggggatgttgtttataattatagagttattataattatggaattatatttgtaagagattttgtgtttgaaaatgttagattaagtttttttttttaaaattagttttaaaaattgttttgttttttttttgtttttttgttttttttttttttttgtttaggattatttgtttttagagtataaaataggttatagataggtgtgtgttaggagttgtaagatttggttggatttttttaggaggtttgggggatggggtatagtttggttggatttaggggggatagggatattgatgtttgatttaaaatgattttttattttaatgttttttgttaggatttatttatttggtttttttgttttttttataaatggaattatgagattatttaggggaaaggggattttttatttttttttttttgttttgttaagagaatagagagtggatgtgttgagttggtaaagtgtatggaggagttggtttgtaggtgtttttttgggtttaagaatttgatgttatagatttattttttttggggtttgggatttgtgtggttgggggaaagttaatagttaggaatggaggggaagttgggttggggggattggtttggatgtgtttttaaattatttttgttagtagtgtgttgggttttgttttatttgtataatgaggggaattttgtttgagggtggtgggggtgggggatattttttagttttgatttaaatttgtgtaaatgtagagggggttggatttaggggatgtaggggttttaatgaaggtgtaggggttgggaggttttttagggtttgaggtttattttgtgggttaatgttgtttttttttggaagagagatggtttttgttttaggagatatgggttttatgtagtattgggtatagttggagatagtgaggtttttttgggggggtggtaggaggttgattttttatagaagtatgggatgagatggttaggatttgggttgggggtagtattttgggttggggtgggggtggtaatttatgtttttgtataaggatgtggttgtatagatgtagttagaggtttttattagttgggattattttgggattgagattattttggagtgtaggttttatttttgtttggagttttggagttggtttattattggttttgaaggttgttagggtttttgtttttagtgggaggagtttattagggtggttagtagggttgttatatggttttatttatgtggtttggtgtgtttagggttgtgggtgagttgttgtggttgttgttggtttttatgttattattttggttgtttaggttggggtttatgaggttgttggtggtgatagaggtagtgttgttggtgtaagaggttagtatgtgggtaggtgagtggttgtttttattgttgttgttggttattatggagaattggtaggagttagaggatgttttgtagtagaggtggtagggggatgggttggtttggaagggtttgttttggttttgtggggtttttgggtagggtggtgggaggtaggtatggtggaagtggttggtggttggtatgtttgttatgttgaggttgttgatgtttgtgtttgagggtgtggtgttgtaggggaaggtagttgatatggttttgggataatgtattttggggtttgggaagtggttttttgtgagggttggtagtgtggggaaggagtggttaaattggtgggggttggagaatgggtttagttttgaggtgtttggaggatagtagggaagaggttagttttagtttgagataattttaggagggttttttgaagaatgattttgggttttggtttttaaggtttatttgggggatttttagttttagatttggtttttttttttttgttttaggttgtttggggttttttttgttaggattttgaatatagatttgttgggaagttggttggagtgtgttttgggttaagaggggttatgggagtttttttatagtagtaatagaatagaggagggggtttatttttttttttaaatttttttttttagttttgtagaggagaggtttaggatgtggtggtggggttgagggtagagttagtttaggttttttagtagttttgtttaggtaggtttttttttttattggtttatgttaatagttgggaaggttgtggatgtgtaaagggttttaatgattgtgtgagattgggagttggaatttgtttttgaagataagaaaatggaggtagagagagagtaagattgagtttttgtggtagagaaaggattggtttttattataaggtttttgttggggatatatgtgttttttttgtttaggtgtagtatgtggaggttttgtgtgtttatatttgggttgtgggtattgagtttataggagttttggtttttattttattttgggtttgtgtttttggagttgatttgtggttatatagtgattggatgttattttaatttgttttggtagtaaagtgagatagtagttagataaatttggggatttagattttaatttggttatagtgtttagtttagattttgtttttgtttttttaggaatgtggttttttaatgggttttaaggtaagggtgttttattttttgtttttaatttttgttattatagatttttaaaattttagtatttaaaggggtttagggattgagtttaatatttttgatggggaaattgaggtttagatagggtgaggtattttttttagggttatatagtatattggatttggtatataattttagggtttttggttttgagttttaatatgtatttgagagggagttgttttgtttttgaggtagtataggattaaggtttattgtgtggtttttggagttggatagttattttggtttggatatttattagttttgtgtttttgggtaagttatttaatttttttgtgtattagtttttttatataaaatatgagatgataatagtttattaggatttagttaatttatattgagtatttagaatggtattgggtatagagtaggggtttatgaggttttgtaaggttattgtggttgtggtgttttttattttgggtatttaggagaattggtttatttagggttttgttaagttgaggttttggtgtagggttttttttttattttggtagttgggggaggtggatgagtttttagtagtggtttagaggtgtagtttgtttagtttagtaatttttttgtgttatttattaaaggataagggttggtgttagttggagtgggttttgtttgttatgttgaggtttggttgaggatggagagttatgagtttgaggtgtgtgtgattttggttgggatttggaattttttggggttttggggtttttttaagttagttggggtatgttttttttagtagtgtattttggttttgggtgtggatttgaatggagtgatgtttttggtttaaggtaagaagatgtggggatagtagtttgggtggtgggggttttttgggatatttgggatgttttttagtaggttatttggttgttttggttttttgaggttgagagtttttgaggtatttggttgttagtttttatttggggagttttttggggggagaggttttgttgtaggtgttgggtatgttagtatagttgagatgggtggggtggaagtgggtgttggttgtttgatgggaattttatttttaagatgaaggaaataaatggggattgtaggatataatggtaggattgtgttttttagagtttatgtgggttgtagggtgttgggttgggtttttttggatttgttattattttttttagtttttttttttagggttattattttttttttggggtggtgggggaagtatttgtttttagtatttttttagattttttagtagtttttttggagtttttgtatttttattttgtggttttgtagttttaggaaatttgagttgtttggggtattgttgagtggttaattttaatagtggaaagaaatgtttatttttttttttagattgtttgggttgttgtatggtggttgaatgagtttttttagttgtgagaagtttttattgtgggtggttgtggttgggggttggggttggggtatgggaggtgttggggtttttgtattgtttgttagtgattaatattggagggttaaagtatttaataggtattgagggaagtggtggtggggtgttttaagggggatttttaggagggagtttgagggtagagggaggagggtttgtgagagtgattttttaagtttaggtttgttagtaatttttttttgttagggatttttttttttttattttatagatgagaaaattgaggttgagtttaagtgatttgtttaagattatatagttaatgtttggtagagtttgaatttttagtttggtttagttgattgtagagtttatgtttgttttgttttggttatttgaggtttttttttttatttaaaggggatgggtttgaggatggagatgtttggttgtttgtggtttagtgttgtggggggttagtgagggattgggttaggttttaggagggagtaggtagagaagtagaagttagttattgttttatataggttgggtttttttttttttagtttaggatggaagtagtagttgtgtttgttgtggggttaggtattgatttttaagttgtgtttatttagtagtggatgggtagatgtgggttttttttttatgggggttggtggataggaagttattgtttattttattttttggattttggtttttttgttgagttttgattttttggtttggttttgtttatggtagagaaaggttggtttttaggttattgtattttgatagatgttggtttatgggtagtagaagtagaggtagttatgtggtaggggtgggtgtgagtatagtgtgtagggttttttttgttattttttgagagtagatttttaatttttgggtttgagagttgagagttttaaatgtattagtttttgggtttagagaggttgggtttggggttttttttaattttggtgttttagtaggattaaggttaaaagttttgagtttaggttagaaggggaggggttttttttttatattgaaggtttgtatttagtttttggttgtagtattatgtttggaataatgttagtagagagatttagttggtttttattttagtgtggtattggaaaagggggtggggtaggtagattggttggtagttttgttttaggtttttttatttgtttttttagaagtatagaaagtttttgggagtaggtattgtggagattgtggatttggttatagatgggttgtgtgatttgagggtggttttgaattttttaggttttttaatttatttatttgttaaggggttttaattaggttttggggaattgagaaagaatgggtatagtttgtgatggtagttagttgtttgtttttgtttatttggttattaagtatttttggtattttatttagtttaagggttggttgtgtatatagttttttatgtttttagtttattgattgagagaatagaggagagatgtagttggtagttgtttagtgagtggttattatgtgttaggtattttgatattttagaagatttgtttgaggtttggttgtaattgtgtttgttgtatttgtttaggtagtggagatggagattttagtttggtttttttttttattttagttttttttgtttgggaggatgttttgggtagggtgggagattttttttaggaatgttatgtgtttttttagggttggaatgttatttaatagtgtgtaaagtttgtgtgagtatagtaatgttatttgaatgttattttagttttgggtggaggtatttgttttaatttatttttagatgaaaaattgtaggttgtggggtaggggtggggaaattgtatatggtaggggtgagtttgttatggttttttggataagttatgttttaattttaataggggtattatggggttaattttatttttttaggtatagtgaatttttggtatgtagatttttggggttaggtattaggtatgtgttagtaatgttagtgtttgttgagtgaatgaatgatggttagtatatagaaagtttataggaattgtttgtaggtgttaatgagtattagtagtttttttataaaataagggggtgtagtgattgatttttggataggtttttggtttggggtagattggattatattgaggttttttatttttattttattttgttgtagtttttttttttgtgttgtattttggattggggtttggggttggttgttgaagtggtttgtggtgttgagtgagttttgggggttgggtgtgtttggtgttatttgtatgtgtagttgttttaggtttttaaagtggttagggaatggtttggtttggttttttagtttttgttggtgttttgtagagtataggaagtttattagttgttgtttttttagagttttagtggagatagaaatgttttattttgttgggaagttttttttgaggtttgattttaggtttttgttgggagaattttgaggttattgttagtttttttatagaggtttttaaaagattttttgaatagagaatggttgttatgtgttattttatatatttaaatttttataatatatggtgatttaaatttttataatatgtggtgatttaaatttttataatatgtggtgatttaaatttttataatatgtggtgatttaaatttttataatatattgtgatgtaaatttttataatatgtggtgatttaaatttttataatatatggtgatttaaatttttataatatatggtgatttaaatttttataatatatggtgatttaaatttttataatatattgtgatgtaaatttttataatatgtggtgatttaaatttttataatatattgtgatgtaaatttttataatatgtggtgatttaaattttaattatatgtggtgatttaaatttttataatatgtggtgatttaaatttttataatatgtggtgatttgaattttaattatatgtggtgatttgaatttttatgatatatggtgatttgaatttttatgatatgtggtgatttgaatttttatgatatgtggtgatttaaatttttatgatatgtggtgatttgaatttttatgatatgtggtgatttgaagttttatgatatgtggtgatttgaatttttatgatatgtggtgatttgaatttttatgatatgtggtgatttgaatttttatgatatgtggtgatttaaatttttatgatatgtggtgatttaaatttttatgatatatggtgatttaaatttttataatatattgtttggtagaagaggaaattgagggttaggtgtagtggtttatgtttataattttagtattttgggagattgagatgggaggattagttgaatttaggagtttgagattagtttgggtaattattgagatttttgtttgtataaaaattaaaaaaaaaaaagaaaaaagaaaaatttagttaggtggggtggtataagtttgtagttttagttattgggatgattgaggtaggaggattatttgagtttaggaggtggaggttgtagtgagttgattgtattattgtattttagtttgggtaatggaataaggattttagatttaaaaaaaggaaattgaggtaatagatatgagaaagtggtttatgtttttaagggaggtagggagataatttaggagtattgttattttttgttttttagtattttagtttgttttgtatattgttttttatgtttataagaataatgggaggtggttttaggaggggattgtaggtttttttagttttaagttattttgggatttttagaatatgtttttttttttttgggttttaggtagaaaaataattttattaggatgttgggtagaggtgtagggggtttgtatgagggattagatagttatttttgtttggaagttggggttaggggatgagatgttatatttggagaaaattgttagtattttttattttttatttgttagagtttatataggaagaattttagttttatatttgaggatttagaggtgttgggagggttaaggtggttaggtttttatttttttgtggtttgttgaggttgagggatatttttggagtgatattaagtttgtagggattttttttgttatatatatttttttaattattaattttatattttataagtaatatgtgaatatttataaaaataaaagtattatagataaggttttgtttattgttttaagtttttttttagagtttttattgtgattagtttttttttagatattttttattttttatgaatggaaaatgtaaagtaggttttttatggaatttttttgaatagttttagtttgggtgtgttattttgtaatttgtttttttagtagtatattttggagtttaaatttagtttttttatttgtaaaatggggatagtaatttagttttatagaaatgatggagtttttataaaattttggggattttttttgttatggaagggatttaataagtatggtgagaatgatgttgtttttttttttttttgttggttattggaggtatagtttattttgtagttttttttatttatattttagttttttttaagttttttttttagtttttttatatgtaatatttttgggaatgtttttgtttgtattttttagtggttgtagtttttttagggttgatttgaggaaaggatggtttttttggaggattgtgtattttagggtttggttgattaattttaatatggttatggttattttattttatgtgatttggtgggaggttgttagttaggtagggtggttaggtttttttttataagtaagagaattgtaattgtggagaggtgaggaagtttgttggaggttatatgttgaataaggggtgggattttttggatttgggattttttagaaaagatggaggttaggtatggtggttatgtttgtaattttagtgttttgggaagttgaggtgggtggattatttgagtgaggttaggagtttgaaattagtttgattaatatggtgaaattttgtttttattaaaagtataaaaattagttgggtgtggtggtgggtgtttatgattttaattatttgggaggttgaggtaggagaattgtttgaatttgggaggtggaggttgtagtgagttaagattatattattgtattttagtttaggtgatagagtaagattttattttaaaaaaaaaaaaaaaaaaaaatgtgggagggggtaagggggaggagaaggtttgtttaaggttttgggtttagaatgatatgtgtgttttttagtttggtagagggagaagaggtaagatgtaggtgggaggtaaaatagaatttattgtgttttttggggtttgaataagtgattgttggggatttgaaaagtgggaaaagtttgttgattattgtagggtatgaggggatagagtttgaggttttgtatgggtttgatttttgatttttagaatgggaatgtaatggattttggtatttgtaggtttttaagttttttatgtatttttgttggaagtttaaataggtatttgggagttttagaaagaaagtagggggtttgggagttataggggtttagttagttattaagaattagggagttttatttttttttttaatgaggttttagattaggaatttatgggatatttggtggtaggaataagattatttggtttttggttaggtttttattgttgttttttagggtttttggtaataaaggggaaaatatgggttgggggtgagtttagttggagttggggttgtaaatttagatgtttatggggatggggtaagttatgtgaatgaggtaagtgggatgggtggggtttggagtggatggggaggagatgttttgtggaaagtatttgattgttattttgaggagggtaggtttagtatggttagagtttttaattttagattgagtttttagttttaataggttttggaggaaatgttgtttttgtttttgaggttattggaaatggtagggagatgtggatgagttgggggataagtgagtagaagaattttaataggtatgaagtttgttgggtggatgtggggattatagattgatttgataatagtttgagtgtaaaggatttgggtgttttagttagttataagtttgaagggagttaatagggttggtgtaaaattttaggttttgttatttttgttataggagaataaagttttttgtttttgagttatattatgtataaagagtgtttatagttatttttgtggtttggtggaagagggtggggttgatagttagtttgggtttgaggatgggttttgttatttgtagtttggtggttttatttaagttatattttttttttttattttgagttgtggtgtttttattatattgtttttgtgggttgaggtgttggtttaaggtgtggatattttttagttatgtgggttattattattatgattattgtttttatttttgtttatgtttaaaggaagtagaattattatttttatgttggagattggggtgtggaggttaggatgttgaagttgtgtgaggaatatagagtttgagtagtaaggtaggatttatatttggattttttgattttaagtttagggttttttttttgatatttttttttttgtttttattgtttagatggggttattgaggttttattatgagattgatgttgagtgtttgttttgggatttaggttgtgggttaggtaatttgattttggaatttatgtttttattatatgtttttttgttttttgtagggtagattttttggaggaggggagtttaatagtattttggaaatagtttttttgttattgtggaatgttggagttattgttagggaggggagaggggagttaaggtggttttatgtggttagggtgttagagagttttagagttatagggttagggtttttatattgggaataggatagaagttttagtgtttgaggaaagaagatggtttttagaaaaagttttttttatttggttatttagagtaagagttgtgtggggagttttggttttaatttattttgttattttgggtttagttttgttatgttttagttttttttttgtatagtttgtttattgaggttttttttttttgaaagtttttgatttaaggtagtaaagattagttgttggttagaggggttttagaaagaaaagaaggtagggttgttggttttagggtttatttattattatttttttttgttgttgttgtttttagtattttttgaatattttttgttttttattttttagagttttagtttaggatagtttttgttagtaatgttttttgttttgtgaagtttagtttaggagttttttttttaggaagtttttttttttttatagtagatttttattatatttttgtaggttagggttgttttttaaagtagttgttagtaggagtggaaattattaaaatggtagtagatgtttgttgggtgttttttttatggtagtgtttaagtagttgataagtattattttgttttgtttggtagtatttttttgagtaatgtttgttattattttattatatgggtgaaaaaattgaggttttggatagttagtgagtttaaggttaagtagaagatatatagttatttgttttttttagagtttgtgaaaatatatttattgtggtggaagagggtggggtttatagttagtttgggtttgatatattaatagatgtattgggattttataatagatgttagggttttgtttagttttaggtttagagttgttatttgtaggtttaggaggataggatttgggagaggaagatgagaaggttttagtggattttattaggggtttttttttgttttgaagtttagggttgagagtgtaatttttaattatattttgttttagattattaagttattttttgtttttgggttatagtttttatatttgtaaagtggttattatattgtttaatttttgagggtgttgatgagttggaggataggttatatgtttttaaaagtagaggattgagatggttggggaaagttttgtgttggtttttagggtttgttttggttgttgttagtttttagttgttgggtttagattagatagtttttttagtatggtttggattagtgtttatgatttttatttatgggagggtagattttagtttgttttttttaagggtttagtggttttaagtttatattaggtagtttttatttattagtggttattgttttgggtaagttatttttgttttttgggttttagttgttttatttgtaaaatggggattatatttttaatttttgagggttaggaaaggttttaagaattatatagtttattaggttttggtttttgaggaaggtgttttgggtttttattttgatttggttatttgtttttaggtaaatagtttttttttgatgtgtttgtgtagtgggggtgatttattttataggtatatgataaaggttaaagtgggagtaggaatgttgggttttagttagtttggggatttattagggttatgtagtgtgggagttagaggattagggttggattttgggttggtagtttttttattattgtttttagggaatttttttttattattagtttggttagtttggggttttatttttgttaggtatttgatgtttttgggggaattaagagattattagggttatttttttgtttttatgtaggtttaatataagtttttgttataggagtggtaattattttagtaggtatttatgatgtgttgggtattgtgtaaggggggttatgtatgttgtttttaagggttatatttttttgataggttgtgattattatttttgttttatagatggaaaagtggaggtatatggttaaggttatatggtgtgtggtatttttgagatttaaatttggaaaggttatatatggagtttagttgttaaggttattgttttttaagatttttatgagagaagagttgggttatttggttgtaaggtttagttggtaagaggttagtttagtgtttagttttttgggaaaagtagagttgggtagggttataggaatagtattgtttgttggggatagtgtgggttttaatgattaggtttgttatttatttgaagttatttggtagtttttttggttgtttggtgtggttgtgatttagatatagtagttattgtttatttagtagtagggtggggtgttgggtttgaggttggttttgtggtttgttaggagatttatatttgatttttaatagttttgtggaattgtaggtgggtgttgggtttggggtggtttgttgtgaattggttttttgtgagtagatgaaagttgggttggtggttgggtagggaaatgggttggttgggggttagtgggtagggaggtgagtggtttttttttagggttgtaagtggggtttttagaggtttggggttgattaggagaatttaggaggtttgtggttaatttttttttttttgttgggtagattttgttagttttgtttttagtgtaggagatatttttgggggttgtggggattttgggagttagggatttggagtagttgtttttttttagtttaggaagaaattatagaaattttaaggtttttaaaggtttaattgtgggtttagggttattttttttgtttatgttaaatttttggtagttatattttgttggttgtttattttaggtttttgtttaaaggttatttttttaggaggtttttttgttttattttttgttttattttttgtatgttttatttttttttttagttttgtttttttttataggattttttattatttgaaatgatattaatgaattatttgtttatttattaatgatttatggagtagttgtgaagggtttttgtttatatttttagggtttagttatattagggtttggtaaattagagtaaagaattttgtttttgtagagtataaataatagggggttgggtgtggtggtttatgtttgtagttttagtattttgggaggttgaggtgggtggattatttgaggttgggagtttaagattagtttggttaatatggtgaaattttgtttttattaaaaatataaaaattagttgggtgtggtggtgtgtgtttgtaattttagtttttagggaggttgaggtaagagaattttttgaatttgggaggtggaggttgttgtgagttgagattttgttattgtattttagtttgggtaatagagtaagattttattttaaaaaataaaataaaataaaatgggagaaatgaataataaatgaaataaattattggattagatagtattttagaaggtggtagtggtaagtgtttggggtaattttaaagttaggaaggaaaagggggagaggtgaggaaggttgtgtgtgtgttatttgaaataggtgggttgttgagaagtgtagaggttttagggtgtgaaggagtgtgttatgtatttgggggtgtttggggaggagtgttttagatagaaaaaagagtagtgtaaaggtttttgaggtaggagtgtttttggtaagtttaaagattagttaggatattagggtggttagagtaggatgtgggagggagggtagggggtaatgggtataggttaggggggtgtgagggttttttttttattgtggtttatgttagatttgttaggtgttattgttttttttgttgggattttggatttggtttagtaatttgttttttaattagtttttagtgattttgagggatattagtattgagaattttagaaattgaggttatataggtaggaagttattaagttagtttttaaatttagttggttatttggttgtaggttgggtatgttttgtagggtattagaggggaatgatttggttatagaatttatagttggttttagggatttatagatttttagtttttggtttttaggattagtttttatttttattttattttatagtgggtttagattttagagggttggaggtggtaaaataggaaaaaagttgggaaaggaagtttaggagtataaaaggtttgtaataatttgtgaaggttgtgggggtattttttggggttaggttttggtaaatttagttaatttttatagtgatttttttaggtagatattaatattatttatttgatagttgagtatattgaggtgaaaaggtttttttaagtggtttttattttttgtagtttttgggttggagtttttagggtgtgttgatagttattttgggtaaaaggttttgtgttttggtttttatttttttttggggttgtttaagagattagttattggggattttgtatagggtttgatgtaagggagggggttgtttagtgattaggagttgttgagttggtttttttatttttatagatggggatgttgaggatttgaaaggttaaggatttgtttagggttaaagataaaggagtggggttgtaatttagggtatggggggggatttgattttagggttaggatatgttagggataggaataggtaggttttaaggatgggggatttagtagattgttttttgattttatttttgttttgttttgtaaataaaattattgatttagttgttgttggggtttagagagggaggttatttgttttaggtggtgtagtaagtttggtttttgatgttgtgggtttttaggtttagtttttgttttttttttttgttgttttgttttgagttatgtatttattttttagtttattttagaaggggttattttaggtttgggagatttaggtagggaagagtaggtaggggattttgttggaattttttataggtagggttgagtttttatgtttatttaggggttttagtagggtagagtgggtggttttggggtgggttgggttgagtatggagggtttttagaggggttaattttgtttggttttttggatttttttattaagtgttaagattttgttttgtgtttttttttttttggagtggtttttttttttttggagtggtttttgagtgttgtatttttatttagagtttaattgaggtttttgtttatgttgattttgtttttggagatatagggtagggttgttattttttttaatggagatttgatatttgtatttttattattaaggtagttatttagttgttgtttatgagagagtttattgttgattaatggtggtggtgggagtgtaggaagggggttgggtattgaggatgataaaatgttgtggatttagtgatttatgggatttttttgtgttatggttatgtgttgtttatatgttgtttttgatttttaggtttgtagggtgggtggtattattatattttatggaggagggagttgaggtttagagaggttagtgatttgttttaggttatattgtagataatagttttggttaaagtgatggattttttgttaatttttattgttaagtgttttttatagattaagttattgtttttttgtaatagtattatgaggtagttgtttgtgtgaatattattttttagtttaggaaattgaggtatggagatgattagtttaaggatttatagttaggaaggttggtttggaaattgttttttatattatggtggtttatggtttatgagggttttttagttattattattttgagatttttggagttattgatttagtttttagatgataaaattgaggttataaagaagatatgatttgtttagggttatgaagtttaaggttaagggtatgggttggtttatgtttgattttagtaggagggaattagtaggagtgtggttagggtaagtgttggttgggagttgatggtgtaggtttgaggatgtgtgttggggtttagggttggtagaggtgattttgagagttttggagggaaatttttttagggttgttggatttagttttaagttttttttaagtggttagatgttgggatgggtttaggaattggatgatggggtgttaggtttagttgatttttaagaagggaggggttagtttagggttaggttttttgttttaggttttttgttttaggtttgtttagtttagaattttgtttttgggaagattgaagtttggggtgtttttttgttttttgtatagtattaggttttatttaggtatttaatttttttaggtttggattttttttttattggaatttgggtgatttttttggttttgttgttattaagattttatttaatagtgattgttaaaaggttttttaaattataaagggttatatttttgagaaagagaggggtgggttaatttttagtgtattaagttgaaaatgttttggggaggtgggatggagtttaggaagttggttggttttattttatttatttatttatttatttagttagttagttagttagttatttatttattttgtggatatagagttttagtttatttttttatttttttagttttaatttgatttttagtaagtagagagaattaaatataaatttgttttgatggattagaattttttgtttatagggtttgggtgtttggattttgggtgatttgagtaagttatatgttaagatttaaagatttagtttttaaggaagaggtttggttttatagttagattagtttttgatttttgattatttttgttttttatgtattttttagttatttgtagagaagttgggggtagagtaaagtaagtttggtttaatttttatttagaaatatataagtatttgataaatgttatatttgaaagttttttttattttttttttttttttgatttttttagtagtttttatggatagttatttttatttttagtttttttgttggttttttatggttttaggttaagtttagagggtttaggggtttgttagtaggtatgtagtgtgtgggggtatagagttaaggattgtaattttttgaggagggttttatttgtttgatttagttgttgttttttttgtattggattttttttttttgtgtaggggtttagggggtttggtggtatttatgtttgggtttttggggtttgtttatggttattttgatggtttggtggtaggttgttatttgggtggggttggtgaatatagtgatggttagggtgaaatttttttttggggagagtggggaatagaggtaggtggttggtatttggagtttttataatattttgtttttttatttgtatttatttttggaagtttttaattgttaagaaggggtattttgttttttttgaatatgggtagaagatagggttttgggtgaagtttaagtttttgggtttggtatttaaggtttttgggggtttgatgttaattttgttaattttttgttttatgttgtgattattttggtttatgtttttttttttttggtttttttgttgttttttttatttagagatttatatgattttgtggtggggagtaggatgggtatattttattttttgaaagtaattggtgatttttgtagaaaaatttaagaatatataaaatataaataaagaagaaaagatattttttttttatggttttattagttggagatagatattgttattatttggtgtttttttttttagttttttttgtatgggtttgtatatttatatagttgtagtggtattaaaatatagatttttatattgtttttttttttatttaattttatattagaagtatttttttatgttattaaaattttataaattttgtttttaatggttgtaaaatattttaatttaaggaagtttttttattttttatttatttatttttttatttttgggtatttatattgttgttaattttttattgatgtgtgtagttggagttgaaaaaggattgatttgggagttgtagatattttttttgtagatataattgttatttttagaatgttttatttttagatagatatttggttttaaagtttttatttaaaatttttgagaggggaaaaaatttttaaaatattatttttttttttttttattatttaaaataaaatgaaagtgattttttgtttataaaaatttttgtttgtatttttgtttatttttttagaagagattttaagaagtggtgagtgattttatggtagtagagggttgggatatattatgggtgtggattttttttggagtgagatgattttttggagagatttagttgttatttttgtgtgtgaggttgtgttatattttagggatgtgtttattaagatggaagattttttatatgtttttgattttgtttgtttttttttttattattagtgagaatgaaattttttatatgattattatttattataatttaatataaattattgttttatgtttttttatttttttgtgaaggttttagtgttttttaaaaattgttatatattaagtttgttaatattttttatgttgtatttgtggttattagtttttttgggtataggtttgtatattttgtttttatatgttgggtggttttttatttttatttttattttttgtttttttattgttttatgtttagatgggtttttttgtgtagaaagtagtttatgaagatttatttttgatagttttttttttattttttatagtgaattttttgatgtgtttgggagtttgggggtttgggtaagagttttttttttattttattttttattatgatttatagttttatgttttatgagattggtggttgggagtgggggagatttgtggattttttaagttagattttatttttttatttttgtttttggattttatgtataggtttgggaattttttgtgggtaggggttaatggttttgtatttttatttgtattttagggttggtataggatggttaaggagagaggttgtttaagtgtatttttttggtgtttttttgatatgtttttaaagtgagtaggtaggttttaatagttttatgttgtaggtgggagatgaagtttagggtggagattagtattttatagttttttttgtatggttgggtatttgttagttaattgattaagtgaaaattttagttttagaggtaggagaatttggaataaaattaaattagttaggttgttaggagttatgttataggatttaaggttttttgagatattagggggaatttaaagtttaagatttattgagtgttattttagttgggaaatgaggggtttttttggaagtttttttttaagttagttggttgaggtagggatagaaattttgattgtatttgtttttggagttttaggttagaatagatttggttttttatttttaggttataggggttattttgtatgatttttggaagtagaagtgtagatggtttagggaagtgttaggtagatgttttgggttttttgtttgattttttttattgtttttttttattttgaggttatttttttgttggattttttttttttttaattagtttagtatttttttggggtttttgagtttttgattttgttagtattgtttagtatttttttggttatgatggggagtttaggtagatagtttagagttttaggggttagattggagatatggaggattaatgggttttagtgttttgttatagggttttgggtttatagtagtatttgaaagtttattaaaatttttttttaggttgtttatttttttagttaggttttttttggttattttatttgaagtaggtatttttaattttaattaatttttttgagataaggttttgttttgttatttaggttggagtgtagtggtatgattatagtttattgtagtttggattttttgggtttaagtgatttttttgttttagttttttgagtagttgggataataggtgagtgttattatgtttggttattttttttttttttttttttttttttttttttttttttttttttttttttttttttttttttttttttttttttttttttttttttttttttttaagtttttattatgtgtttaggttggttttgaatttttgggtttaagtgatttttttgttttggttttttaaagtgttgggattatagttgtaaattattatatttggaaggtatttttaatttggttttgtagagttgaatgagtttgagaattagggtaggaaaaaattataattgtattgtttttaatttttaattgaaatttagtattatttttaagtatgagtgtaggtaataaattatagaggtattattagttgtatttgtgattttgttattaatagatgttatagatatttatatattatattatagttgttgtagattgttttaaatattttttatgtttattataattttaaaattatggttgttattaggtttaatgttagattttatttaatatattgaataaagtagtatatttattataatttttaaagtattttgttatgttttaatagaaatggtttttattgtaatattttgtatttgattttatattttaaaaatattattgttttgagaaaggtgtgtgggttttattagttattagaggggtttatagggtaaaaaaaaaaaaaaaaaaaaaaaaagtgttaagtagtttaatttgaagtattataggttttattattttttttttttattttttgtatttgttggaatttttttataatgtatatgtttttaataatttatttatttattttgtttttttttattagattataatttttttaggggtttaagtttttgttttgtttatgtagtgtttttagtttttaggatggtatttggtatagagtaggtgtttaataatatttgttaaataaattaagggtagagataatggtttttattttgtatataggtattaatgttttgtttttgagaagtgagaagtttttatttatattaggtagtaaattatatgttatttttgaggttattagtattttttggttgtttttattagtttttatgtttgttattattttttttaggtataaaggagaggagtgtggggtttaagaggaggagtgagagggaggggtaggagttttggattttgggagatagggagtttggggagtaggggtgggagaaagttgtttttttgagtgttttttagttattttggttttgtttagttttttttttgtttggtagtggtaaatttatttattttttttttttagtttttagatataattttgtgtaggagttttaggtaaatttgtaatttattaggagtttaggaagtgtaaatttaggttttttgagggttggttttggttgtaggggagaagttttggtttgggaaatgggttttttttagggttttagaaatttttttaggatttattattaattagttggggtggtagtagggttttaggtaagtttttgagtattttttgtttgggtttttatgtgtataaggtttttgttttatttataggagttgtatgggtggggggaggggatgtgttttagttttaggggattttggggtttttttagttttagttaagaagttatttattttttttttaattagtggttttttttagtttgtattggtatattgtattttgaatttttgttgatatatagttgttttttaattagttgattatagtttgagagtttatgtgttttttatttttatttaggttagtggttgtttgttagaggggtatttttgggatttgtggtggtgtgtggttaatatagtgttggggtggtattgttagtgttaggggtggggtgtgtgtatgtggtgggggatgttagtatttaatgttgtttagggtggtgaagatttaattttttttgggagggaaaaatttgtttataaaagttttttggttggttgtagtggtttatgtttgtaattttaatattttgagaggttgaggtaggaggattgtttgagtttaggagtttaagattagtttgagtaatatagtgaataatatttttatttttataataaataattttaaaaaattagttgagtatggtggtgtatgtttatagttttagttattgaggtgggaggattgtttgagattaggaggttgagattgtagtgattgtattattgtattttggtttgggtgatagagtgagattttgttttaaaaaaaagtaaaagaaaaaaaaattatttgagttatgaatttaatttagttttatataaaataagggttttttttgtatttttaatatttattgaattttttagaaggaaagatagttttttttttttttttaattttgtttagtgttttgttaataggtgttgataattttagaaagttatggtattggtagtaaggttaggtttagattgagttttgttattttgtttgttttttttgttgtgggtttttgtatggagggtatttgtttattttatggagttttgtggttttaatgtttatatatttaaattagtgttttattataaattattttttttttttttttttattatagttatggaataatatagtttgtaattgtatgtaaataggtaggttttattatttatatattttaatgtagaatagtaaggtttgatataaaatatgtattgtaagaaaggttttttgtgtttggtagggtagggattttagttttaattattgtaggagatagtaatgatttggtttttttttttttttttttttggtttatatttttagttttgttgttaagagttttgtggtgttattgggtgtgtgttttttatggaaagttatttttttggaatttagatagaatgtagaattaaaaattgaggtaataagtagaggtttttattagattttttagttttggtagaagttaagagatttaggtaagggttttgggttttaatttttagttttaatttttaaagtgttttattttttaaagtggtttagattgttattgttaattattgattgtttttttaggtgggaattttttagttagtaggatgggtattgtagatgtgtgtttgtatgttagtggatttggtatttttttttttttttgttaattgtttttattttttttatttagtagtttatattttttgggttttttttatttttgtttaaattatatagtaattagagaattagtggttgttattgtttaaagggattttaaagtttttttttagttttaggtatttgaagtaataaaatttttaatatgtatttagtttttaatatgtgttagttgatatatttgtgttaatttttttaatttttttaaaattttatgaggtaggtattattattatttttattttatagatgaggaaattgaggtatagagtggttaagttatttgtttaatgttatttagtaagttattagtagagttgggatttaaatgtagggtggttgatattagaatgtaggtttttaaagattttgagtttttgaaggttgaatgttttagttatagttttttagatattggaatttttttttagattattttttgttttttaggattattgagattggttatggatttttgagaggagatggatgagagaatggtttataaatttagttttttgtattttttagagttatagttttagttttggttatttttgttataaggataagtttttaattaatgttttggaaatttatttttttttttgtaggtttggggaggggggtttaaggtttgtgggtatgaaaatttttaaaaaaattatttttagtgtgtagaatggttagataaggttttggtaatttagaaaattgttgtttttttttttttttttgttttttaggagagagagtgggaagggagaattaagtttttgatgttttgttgggtttttagattgatagtattttttgtttgttttgtaataggtagtagttatagtgtttttgatatatatttgggttagtagatttggttattgttttgtagttagtagagtttattagttttgtttgttattgattaaggattagtgattgtttttttagggttgggattaagttgtaaagggtttgagagattggggatgataaaagggatttggagattaattaggagtagtaatgaaagtttaatttataaaagtaaatattttttatttattaatttgtaattagttaagggtattgtttgaaagaaatttgtgtgtggggaagggagttaataggaataggaaatgtttgaaagaatgtaaattattttagttttataaaaagtaataagtaaatagttattatatgtaaataatgttttggttttaattaatgttgaaaagttaaaatatggttgatatttgtatgtatatattgaatggttggaaaggaaaaaatggtgtttagatgtttgttttagagtggggttggtagtttagagggaattagaattttgagaaggttttgtttattggtgatgaaaagtatggttttgttttagttattttagtttgttgtggagttggggagtagagggaatttagtttattttttaataaagttagaggtgggtttggtgtttgggaagggtgatttttattttagttattttttgtaggtaggttggttttaaagggttagtggatttttaggtttttgttttataggggtagggtttttaggatttttttatttaggagttaagtgatgatgggttttaggttttagaagttttttatttaatagttttttatttttgttttgttttttttttgttgtttaaggttggttagataggtagggtggtatatttgttttgattttggggtaggagatggtagtttttgagttgtgttttttaatatttagttgtgttagtttttgttttagattatttagggtttaaaggtgttgggaaattgggtttgggagattatagttggagagatagttttagagtgtgggggatattttgttttttatggagagagtggttggggtgtttgggttttatagattagggatttgttttgtaattgttttgttgaaagatttataagttttttttttgagtttgttaatttattattttttgttagtattttttgtgagattaggtgtgtttaattgggaaagagggggtggtatgaatggttttaggagttggtaaattttagaaattgggagaaaattgtttttttttggtaagagattataattttttttatttttttaaagtgatttgtaatattttataggattataaattgttgtttttagatagagttgtatttggagatttgttttttgggattttaaggttttttttttaatttttttttttgttgtttttgttattgttaatgttgaaatggtgaggttttttttttatttattttgtttattgtggtttatgaagtgaaggttgttgaatttggttatttggttttttatgatggttgaggtattgtgtagtttagtggagtagtttttgttattgtttgttattatagttattattgtattatttggtatgttttttaatgttattatttgaagatatggggtggggggatgtagggggatagtttagaaaggaagagggtgattagggaaaggaggggaggggttgggttgggtagtttttttaggttttaggtatattgagtatttttttaatgtagggtggagaagaggtttaaaaataataaagatttttttttaaatattatgaaaataagaagatggaattttgagtttttatattaaaattttagattaattgtttatataaattgtgttttaagaaattatttttttaatgaaatttaagttagagttgtgaattagtttagttattatgatgtggggtgtagtttttttgttgtttttggttgtagtgaaagaggaattaatatgtttttagtaatgaagtttttaaatgagaaagagtaataataataataataatagggttgttatttttatttaatttatgtaagagttgtttagggtatgaaatttggttttgaaatgtggattaggtttagtttattggtttttgtagagtttaaatttgttatgtagagaaaatgtagaatgtaaaatttattggtgttttgaaaaaggttattagaaaatttttttaaagtgagagtggggtttttgataatggaaggatgtatttgttgggaattgtaggatgggggtggtgatgtttttttaaatattattttttttaaattttttatttttaggagtatggagaggtggatgttttttgaaaaagaattagattttaaatagagttataattatttaaatgtggttgttgtgtgtagggattggggatttatatggtaaaaattttaaggagaaaatgtttgggatttgattaagaagattagattttttgttaatattttgtttttttttaattttaaagattttttttaagttttaagtgatagtaaaatttttgatttgatgattaaagttatatgggttttttgttttttttggtgagattttttttattggtattttaagatgttatttgggagattttaaagagttatttttttttttttttttatttagagttgttttaatgggagtagggatggttttagtttttagttattttgggtagtattatttttagttgttggttttttttgttttgttttttttttatggtagttgtgagaggtttaggggaaaattgaggtgtttttgttttattttgttgtttttttaaaaaaatgaaaatgaaatagttgtttattttttggtataaagaaaaaggttttttaaatggttgggggttgttagggttaggggttttttaattttaatttgttatttgggatgtataatatttttgagtaaatgtttggagagtagtgttttgattttggtttagtgttgtttggtaaaattttggaagtttgagggtgtgagtaggaagtttttgtgaagtggtgtgggaggaggggtgttggaggtggagggtaggtttttttattgtttgtattttatttgtggtgtttttgtttttgttttgggatttttttttttgttatttgtagggttgtatttgagtgatttgggttaggggggtgtaaaattttatttgtttatttttgtattaatgtttttatgtaaggtgttttaaaatttaggtggagtggggtaattttgttaaaagttatttttgtagggtgtatttaaaatggaatgttgaggttttggagttgagtgtgtagttagattgaattgggtgtttgggtgttgttgtggtgttttgggtattttttatttttattgtttttgaggttttggtttttgtagtttagatgtttggagttttagggttggtgtttttttgttttgggttttgtatttattttgaaggtgatgggtagtgttttgttgtagtgttagtgtgagggtagtatggagtagaggaagttggggttgttggtgtgtatgagtttgtttgtgtggtttgttagtatgtttattattgagtgtattttgggttgggtgtgttttttgggttttatggttgtttgtgtgtttagtgtgttgttgtttttgtttattttgttgttgttgttgttgtaggggaaggttggggagggaggtgtgaagtggtggttggtgtttgggtttatgggaatatgtataatagtggttgttagggtgttgggtaggtggagatggtgtggttttttttgggggtggttggtgtgggtgtttttttggttgttgttgttgtgagaagtgggaaagtagaagtggtggggtttgggttttagggtgtagggggtggtgtttggttattatttgttagggtttgtttgttgtgaggttttgttggtttgatggttgtttgtagtttgtttggttagttttgtatttttggtgtgtggttttgtgtgtggttgttttttgtggttgttttggttgtttgggttgtggtggggtttgtgtggggttgtgttgttgttgttgttttttgttttgaagtttgtttgtggttgttttgattttgtggttgtagttttagaataaattttttagaattaagtggtggggttgtggttgtttgtgtggggttagtatttttggggtttgtggggtggggttggtggagtgatgtgttgtatagttaattggtggagtttttattgtgggtattttggtggtgtttgtggggaggaatggggtttgttggaggttgtttaatggggaggggtggaaggtgttattttgtggaggaggttttagtgttatagtttagggtttttgagagttttgggagtttggggtaaatgttagaaatttgtttagaatgtttgggttttatggaaggtgtttttgttgtttttttttgggttgtagttttttgatgttggggtgtaatttttttgttttttttttttgttggttgtggttgggtttttttagtttttgttgttttgggtttgtgatttttgtaattttgggttgggggttgtggggttttagggttggtgatgttgtattgggagttgttttaaagaggttatttattttttttgttttgtatattattttgatttaagagtttttattttatatgggattttgtgtgttgtttatgtttggttggtggtttttgttgtttttagttttgtgtggttttggttttagttttggtggtttttgtgttaaattggggataggtggaagggagttttttagggattttaagtagtttggggttaataattttttttttttttgttttttttttaaaataagttttaggattttgtaggttttgtggtgttgttttttgttgtggtggtttgtggttttttgaaaaatatgatgaggtttgtaaaatgtgttttttttttttttttttatgtatgtaattatggttttgtattgtgaaatggtatgtgtgttggtggtaaaagaaaaatagtagtggttgtaaagttaagggtttttgtttttagaggagagaattttttttttttatgtgggtggaaagtggtttttgtgggtttaattttatttttttttgggtttgtgtgttttggttgtgttgtagggattgtggatagttttgttaaggtattgtttgtttgtttggttttgggtttttgtttttatttttagttgtgtggtttaattttttttgggttttattgtaaattattttttttttttttgttttttaagtttgttgagtagatttaggggttggttatagttgggagggtaatgggaaagattaagttataattattttgaattattgttttagatatttttttagattttggggaatgaatgtgtgttgagtttttttgttgttttggagatggggttagatttttgttgtttttggtttttgataggtgtaaaataatgaattttaagttttggaagtaaagaagtttaggatttgatggtggttgtaagattttattatggatttgatttttgtttagtgtgtgttattttgttgttgttaaatgaaattaagttttgtgtgtgttttaggggtgaaggattttggatttattttgattattgggagagttggtttttatttattttgggattttatagtatgtttttaggttgtgttgaaaggaaggatggtaaaggttttttattgaattttttaagagagtttgtgtttggtagttgttgattgtggatttaggtttgtgtgtttttggatgtgttggtatgagtagtagaattagaggaaagtgagtgatttagtttgggtgtttttatttttgggaatgtttttgagaaggtgtagtgtgttgtggttaggtagggttttggttgggggtgggtaatatgtgttgtttttgagtaggttgtgggattatgatttgttgttttaggtggtggtaaattttatttgttgaatggttttggtttgtattgtgttttttgtttgtttttttgtttgatttttttttttttgtttatgatgggtttatagataagtttttagagaatgagggatttttgtgggttttggtatttggtgtagggtttggtatggttttggttttttgtagggtgttggttttttgtgggtattagatttaagggattagggtggtggggggagggggggtgggtgtaggtttttgggtttttagattaaggttgtggggttgtttggtaggtatagtggtgggagttgttgttagttggtgtttgtgttttgttagttgtggaggtgtgggtttggttgggttatagatgtgtgttagttgtggttttgggtgtaggtgtggtgattgtttttgaggagttgttttttttttgttatttatgtggttaggttttagataaattgatggttttgtgttaaattaaggttgttttttttatttttgataagatggatgttttttgtttttgtgtttttaggtatttggggaagatttatagaataggttagtttgtttttaatttttatttgttttttttttattttggattgataaaaattgttgtttgtttgatgggagggagaattttgatttttttatttggggtatgtagatatttttgtttttttttagttggtatggattgttgtttttttttttttttttattagattgatggataaataggttagtttttttttagtggtttttatttaagagtattttaagttgtttatagtagggttaggaagtagaaggttaggatatttttttattttattttgatttagagttgggtaaatttagaatttatttttgggtaaatagagttagtttttttgttttaggaaggggatttgtttttttttggtatttaggagtgttttttaagtgtgtttttggtagtgagggtgttgtttttttagggtaggtgtgatttatgtggattttgtggtgtttgggtagggatttttaggtatattagataaggggtaggtgtgttttgggaaattgtttaagaggtttatgggttatggaaggagttggggtttatagtttttttgtttgagtgtgttttttttttttatttatagtgttttagggaaagttgtttaaatttttttgagttttattttttttatttgtaaagtggggtatttatagtggttttttatagaattgtgtgtaaagtgtttagtataggtttggtatatggagggtgttttagtttttgggagttattattgttatgaaaaaataagattttttaatttttgttgggggtttttgatttattttttttttttttgggttttatatttttatttgtgaaatgtttagtttttatatttaaagtttattaggattttaagttagtttatgttgttttgattttttaatttgtttataggttgtttgggggaggtaaggattggttgtgatttatttttatgtggagttagtttatagtggggtttttagtaattattatagggtggttagagttgggttttgatgattgtttgtttgattattttttttagaattttatttttgtttttagttggttgtttttttgtgggtagatttttttttgagtagtaattgggttttagtggatattgttagggattttgttttttttttaggaggtttttgttttttatattttgaattatataggagtttagtttagtgaagagagtagaggatttttttttagaattgaaaattttttttagtttggttttaaattttttgtttagagggatttgtggtgaaatttattttttgtttagtgttttagaatttaaaggggatatttatgttttttattgagttttaatttttttttttgttaatggaggttattttaattattttattttatgggagggggattaaggattttttttaggaggggaggggtattattgtgattgatgattgattgtttgaagaaatagaaagaaaatgttgttgagtaaattaggatttatttgtattttgattttagataatgatttttgaatatataagtgagaaatgttaatgaaaaatggtaatatatttgggttgaggggttgttttttgtaggttgggggtttagttttagagagtttagttttggggttatttattttgggtagtttttttggaaggatttagaatgtgtgggagtataaatgtgttttttaaattatagagatttttttttttttttggaaagttttagatttggaggggagggagaaggagtaagggagagtagggtggtgagggtgttaggatttagatgttgtttgtgtggtttgagatttttgtttggtgtttatgtttttttgagttttggtttttgagggtaaaatgggaagaatagtaatagttgggggtgttgaggttttattttgtgttaggtgttgtatatgggtattgtttatggtatttaatttttatggtgttatatgtggtaggtgttatgtttatgtaagtaaagaggaatgttgtttgaggttagttaggttagagagggttagatttgggttaaaagtttgttttggtttaaaatgtggggtatgaatgtattatttggttaagtatgttagtattttttttttagtggttgagtaatgggaagagttagtatttagatatagaggaaagagttattgtgatggggagagggagttgggtttggtaaattttgttaagtagttttgggtttggaaattagtaaattttttaaatttgtagggagttaggaaggatttgttagggttatttgggagggttttgtgatagttaaggtgtatttattatttgtttttttttggttttagaattagtttgtgaggaggtaggattggtagtagtttttagtttatagatgggaatattgaggtttagaaaggggaaagggtgtgattaggatttggaatgagttttagtaaggttaggagtaagtattttgaggtaaaatgtagttggataggatttttgttttgtaggagattgtagtttagttttgggttttatatattagtattttgatgttatatttagtgttttttgtttaggggaagtgttaattagatgtgtttttttttgggttttagtgtttgtatttgaatgtgggggtgtatttttaaggtttttttatatgttatgtgggttttataggattttagggtttggttgtgatttgaggttttttttttttatttattttttttttattttttgtggggtgttagtttttttgtgtttatatgattttggatttttttatgtttatttttattttgttttgtaggtgggtggttagagggtgttttgttttgaggatgggagagagaaagggaggtaaggatggagaaaagagattttttttgtgggagtgtagagtagaaaaattgtttttattggttattagggaaggggtttttggttttagattttattatttggtggggtttttttattattttttttgttatttgtttttgttatttgtaaattagggaaatatttttggaagatagttatttggtttgtgattttgattattggtttatgattaataattgttttaattttttgaatatttgttgtatgttgggagttttttgttaattgttgtttatttttaggtgtttttgaagggtagagattttattttttttattttatagatggggaaatttaagttttgaaagtaaagagttttttttttgtgggttttagaatttgagaagtttaaataggtttttaggagtttttttagtattttattttttgattagggaggggttgtttgtattttgattgttgtttttagtgtagagttttttatttaaagtagtaggtgtgtgtagagttatttgttagtagagttattaaatatggatttttttattgggagttatggagtggtgagagagatttgggtagtttggagttaagggggtttttgggaaatatgtgttttttttttagggtggggtttagttttggtgggtagggagagaaagggtttttttgagtggttgttgttttatatatatttttgttttatagtatttttagggagtagtgatagttattatttttattttataggaaagaaaattgaggtttagagagtttaagtaatttgtttaagttggtattattgggaaattataggggtaggattttaatgaggtagtttggttttagagtttatgttgttgtttattatattttatttttgtggattaaaattagatgtttagagttatagttatggaatagaattagaattttggtagaagaattgtgggtaggatttggaattttataatgttagatttgaaagggttttgagatattaaatttaaatttttattttttaaatgatagaattgaggtttaggaaggaagagttttatttaaggttatagttagtgttagggatagagtttgtattttttgtttttttagttattttttgttgattttgtattttttttttttgtaggtttttttttttttattgtttatttagtagtttttgggtttagttaggtttattagggattttttatttttttaaaaaggttttgatgattgttagtttttgtgaagttttaattaattttagaggttgatggtttggaggagattgggggttttggttttatgtagatgaagattgtggttttattttatgtggtggtgaaagaatgttttagatatttttgttagtaataaaagttatatggttttttagtattgtttttggaaaagaaaaaaaagtgtagttttttgtggaaataaattaattatgtgttgtatgtatggtatgagatataaatgggtatatggaggtgggtaatagttggttttttatgttgtttttgatgtttattgatagtggtagggttagtggttatggttttagttgtaattttggggagagggagtgatttttagtgtggtgggggaagttttagtttttttatttgaattggatttgagttattttagatattttagaggtagggttggttttttggtttgtgatttatgtagttgtatagggttttggttttagaagggttttgagtttgttttaatgttttgttattattgttttgaatttttgaatatttgtttaataaaggttttgtgtttttattttgtattgggttttttaaattatatagttagttttgattataaatttattttttattattaattgttatgttttttttggtttttgttatgtatttaattttggggagtagggttttttgagtgtttattagttagtttgtttatattatttgagatgaattttagaatgattttgtgaattgggtagatgtggaaaattgaggtttagagaggtttttatatggtaaggaagtttagatttgaatttaggtttttttgattttaaagtgagtgtttttagtagttttatattttgtattattttatttttattatgtttagggggatggggatatatatagttaggttgttttatttttagataatagaaggtataattgaggttagagaagtgaaggtttttaagttagtgttaaattgagggtttgggtaatagtggatttgggtttggatttatagggttggggatggagttttagttttatagttgtttgtgttatttgtaaatttattagttttttttatgtaggttattgttttgagtttggtttggaatgtggttggagttttattttgttttttttttttatagttttttattttaaatatttggaagtttttttttgtgtttttttttatttttttatgttgtagtttttttttgttatttttattggttgggaagtagttggatttggtattttgataaatttaaaagagtttaaatttttgatgaaagttggggttgaatagagtttatagattgttatgttttataattaggtttgggtttaaggtttatagagttaattgttagatttagggtagttatttttttgttttttgttgggtaattttgagtaagttttttttttttttggtttttagatttttttttagggagataaatgtattggattatatttgagttttaggaggtttttttgtttttaatattttagaattttatattaatttataataggtttgtttatttttgtatttaatagttggggaaattgaggtttaggaaggattagagatttgtttattgttatagaaggtgtttattgataagtggatttgattttgaggtttttgttagttggtttggttgtttttgtataaatttttggaggatttggttttagtattagtttagtttgtttttgttttgttgtttttagtttaggtggtttgttaggtatttttagtgtttaggtttggaaattatagttaagagtttttggtaggtaataaagttttttttttatggtttgaatgttttttaaaagttatatattaaaattttatttttattgtgatggtattaagaggtagtggggggttttttgggaagtgattaagtggtgaaggttttgtttttatgaatggattaggttttttttgtttttttgattttaggatataatgttttgtgttttttggaggatatagttagaagatattgttttggaaatagggagtttaggattttattagatgtggaatttgttagagttttgattttggattttttagtttttagaattatgtgtagtaagtttttatttttttatttataaattattttgttttaggtattttgttatagtgatatagagtgaattaagatattttttttagataaaagtgggttaggggatggtagtaatttttttttttttaattgtatttgggttgtgttagtgtttttgtaataaaggttttttttttaggggttataatttggttggaaaatgaggaggaaagattagattttaggattggaggggtatatgaagtaggaggttaggatgggaaaagtttttattggattttgggtatgtagagtgtatatatatatgtatatatatttatattttatatgtgtgtatttatatatagtatttatgtttatgggtatagttttttatatatttattggtagtttatatttatatggataagtttttatggaggatagtattgttatagtgtagttataggtgtaaatagttaagtgtaggtgtgtgtaaagatgtttttaggagatgtttttgtttgtattattatgtatggatttattggtatagatgtgtagatagatgtatagataggttttattatatgagtggtgtggatatatatatgggtagaaatttatattatagttgtgtaaatagtagattattgtgtggataaatttttatatatagaggtaggtatggaattagggtttagagttttggatttgttttatagagtagttttgggaggagttgaattttggttttggaagtttttgtttttttttaatttagaggtatggattttttgggtggtttgtttttttggggtttttaaattattttttagtatttgagtttaatttgtttttttattgtttgatggggataaggagagtttgtttttttggtttagagaaaggtagtgggaggggagaagtgggagggttgtagttagggtgttttatggtagtatgggtggaagggtagggtattagtttaggggtttagagatttgagtttgggtttaggttgagatgttttaggttaatatatggtttttttgggttttattttgagttttttttgttagggttatgtgatatttttaggggttttagtatggggaagagtattgaaattatgttatatgatgaattattaaagtaattggagattttgttttggaggagagtaggtttggggggtaagagtttttttggtagatttatgaagagtttttaggtggtagggattatatggatgttgggggttttatattaggaatagaaatattgagagttggtttggaatagggatatgtttttttagaggtagagattaagttgagattaggatattgtgtagggagtttgagtgttagatggggtaggggttggattagatattagtgttttaaatgtttagtttatagtaaatatgtattgaataaatgagagagtgattgtagagttttatttttgagttaattatttgtgatttagagtatattagttttgggtttttattttgttatttgtatgattttggttttttttaaattttagtttttttatttatgaaatggggagaataaattatttttaagagttttagtaagttatattttttattgttggttttttaggttattttagaatttttgtttttataaatagaaaatgatattgaaggtgaaaagtagatagataagtaagagaatagttaatataaaaattatagttaggtgtggtaatttgtgtttgtaattttagttatttggaagggtgaggtggggggatttatttgaggtttagagtttaagattagtttgggtaataaagtgagattttgtatttattaaaaaaaaaaaaaaaaattaggagagtggtttttattatttgttatttgtgatgagtagggagagggatgtagttagggaagggatattggtgggagttttaaggttttattagtgttttgttttttaaagttaggtggtaggtagatagatgtttgttttattttttttttttaaataatatttatattttatatatttttttgtatatgtattttatatgtttaaaaatattttaaaggaaagtaaaagataaaatatagaaaaagtttttttgttttaaatttttgaaaaaatggataatatgtttaaatgtgtataatattgtataattatttatgatgtagtaaagttgtattgttttatttggatggttttgtgtattattatatttttagttgaatttttgtaggtttttgtagttgtttttattatggtaatttttatttaggtaagtatttttaggtaatagtttttgttgagtatgttttttaagtattttttatggttgattagtagttttttaggtatgtgttagtgggtttattttataggtaaggaagttttttgtatttatataggaaggggtagagttgggatttgaattagttttgttaatgttaaagttgtgtagtaattttatttgaggagttaggttttttgattatagtaattagtgttatgtatatttatatatgttgttgaatttttggagttatttttgtattaggtatatttattattatttttattgtaatagtaggataatggaggtatagtaaggttaggaatgtgtttaagtttatattttaggtgagtattagagttgagttttgaattttagtagtttgattttagattgtgttttttggtttggttgtgtggggagtttagattttatggaaataaaagatagaatggtggttttagggtttatagtggattttaagggattagaggttagtaggggggttggttggggttggaggatgttgtttaggagatttgtttttagagtgatgttagttttgtgtgatgatttgagtttttgtttttttatagggttatggttgttggggaggtgttgaggttgtgggtatagttaaatggagttagagtaggttttggattttttgtttggtaagtttaggtgataggtttagatattgggtattttgttatttgttgttggtataagtttttattggtaggaatgtgatatttattatttgagtgggtttttagaagtttattgaatgtttttagatttggggtggggggtttttttattgttttatttttgagttttaattaaatttagggtggttggatgatttgaaggtttttttagtttatggaggtttgggtttgtttttgtttttatttgtgtttttaggggaaaaggtttttagttttgtttttagtagttttgagtttagatgagggggggagatgagatggaaaggaaaaggagaagtaagaaatagatagaggaaaaggagttggtattagattgaagtagttaatatatatttattaggtatttagggttattttaggtgttggggatataagtaatggattagaaagttatggagttttttgggggttttgattttagtagggtagatagaagatagataaggaggtaaataaataagtatgttaatatttgatagtgttttgggatatttaagaaaatagatgggggtaaagttagagagagtgattgggtggatggggagagaggggtttttggtaatattttagatagggtggttagggaaggtttgttggagtaggtgatatgtgagttgagattagagggttgagagggatttaggaagggagaagggggttggtaggagggtttattgtatagtggaattggttttatttatttgttttttttttatttttttgtattgttagtatttttagtttttaaaatttttattgttttttttttttgttgttttttttataatagttttgagagttagatggggtgagtttaagtagtttgatttgtagtgtaggaaattgaggttagagtggggagggttagtattagtggtgttttaatgttaggatttgatttgggtttttgttttttagtttggtgttttttggagtttgtttattgtttggtatgttatttaattattttagtttaggtaggttgtagttattgtggagttagtttgtgggtattgtttttgagaggttataggttggaaatgtgggtagttgggtagggtttaggagggggtagtggtttaggattgggtgggggtttggagtggaaggtgtttagttttgattggaataaggtggtagtattgggagttgagttgggtgttattgattttgtttggtgttttagttattaggtgggattagtgttgggtagattgttggtttttttaggtgtggggatattttgagggaatgattttttatgtggttgtggggtaggtatgttatttagtatgtgggggaggttagggttttgggagtatgttggtagtagggtggaggggggtgtttggagatttagaattttatagttagtaaatgtgaggtttttggagatagggttatggatttgaggttttgagattttgaggatgttagaatttttattgtagtagtttttattgatggtgtgtttatggtgttaggtatggttttgagaatttatatagtttaattttttatttttgttttattttaagagggggttttgtgattatttttatttatagttggggaaattgaggtttggtaaggttaagtagtttgttaaatatatagttattaggtttttgttttaggaaataagagttttggaatagttggttagtgtggagaggatttttgaagatttttgaggttagtttttttgtgttggaaaaataggtttggagaggggatgtgatgtgttggggtttaggggagtttaaagttaggatttattttttttttaggttattgtgggatttttgttggtttttgaatgttaggttttttgagggtagggtttttagttaggatttaggtttttagatgttattaattttaattgatagttttttgttagtatataggaagtttttttgaatatttaatttgaattttttgtttgtagggaaagtttttttttttttattttgtagtattttaagaagagtttggtttttgatgttagggaagattattagttttttggtgttgtgggaggtgagattgtgtttttttttgttataaaatatttttttattgtttattgttgggtttaaatattagtgatttagtttttggggttttatagagttttttattaaaatgtgagtatttttggaatgggtgttagtttagtaggatagggtggtattttaggggtagggtttgggggttgttgaggggtaggagagagttgattttttttttttagttaggtttgatggggtttatatgatttgttattttttatttttttgattttatttgtttttattttgttttttttttattttgttttagttattttgtttttaaatatgtttattatatttttattatagggtttttgtttgtgttgttttttatttggaaaattttttttattttgtttgtttggtttagttatttattttatttaggtttttgttgttttttttaagaggttttttttggttttttgtggtaggtagaataatggttatagagatgtttatattttaatttttaaatttgtggttatgttattttatatggtaaaagggattttgtagatgtgatgaaggataaagatttttagatgggagattattttggattttttaggtgggttttatatgattataaggatttttatatatggaatagggaggtagaaaaggatagttggagggagatggggtgtggaaattgattagggaatttgagagatggtagtgtgggaaaaatatggtttaaagttgtgggttttgaaggtggaggaaggggttatgagttatggaaagtagatagtttttaggagttggataagataaggaaataaattttttattagagtttttagtaaggaatatagttttgttttgattttgattttggttaagggagatttatagagaatttttgatttttggaattgtaagattataaatgtatgttttttttaaggtattaaaagtgggttaatttatgatggtaggtataggaaatgaatatgttttttttttttgattgatagttttttagtatatttattagtgtttgatatataatagtttgatttatgaattgtttttttttttttatagaaggttagttgtaggagggtagggattttttgtttgtttggtgttatatttgtagatagagttgttatatttaataaatggaaatataaaatatttagttaaattgaattttagataaataatgaatttttttttagtataaagttgttttaaatattgtaattatttattgtttatttgaaattaaaataatttaggagttttgtattttatttggtgaatttatttttaatatataaaattatttttgggtatgtattaggattttaataaatgtttgttgaatgagtgaaatagataagtaaatgaatttatattaatttttagtttaaaaattttttttggtttttagaatgtttatagggtaaagtgtaaattatagtaaatgataaaagtagatagttttatagttgttttaatatgttagatttgggttgagtgttttatatttattaatttatttggtttttgtaataatttaatgaggtggttagtttattttttagatgaggaaattgaggtttaggaggtttagtaatttgtttaaagttatataattattgagtagtagagttaggtaattttaggtttttgaaaatttggtttatggaatgttttaatgttatttttttatttatttttttgaatattgtggattttttttttttaatagtttttggtttttttttagggtatgtgtttttgtattttttgattgttgaatttttttttatatattaaagttttgttttatttttttttttttgtgagattatttttaaaatttttaggaggatttggtttttttttttttttttttttattatggttttttgtttgaatgtgttgtaaggatttgttattgtgttttttatgttttttgattgtgatttttttgagaatggagatgggttttttttagttttttggtatggggttttaaattgagtttggttttaggggggtttttagaagtatttgagaatgaatgaatgaatgaatgaatgagtgagtgaatgaatggttgagtgaatgaatgaatgttgtttgtttttattttgggttttagttttagagtttataaaaggggaagaataattttgaattgttttttattttttaaaataaaatatatttttttttgattataaaaataatatatatttattaaagaaaaattggaaaataataaaattatgaagaagaaaattaaaattatttataattttgttatttagaataatggtttttattgggtgtttagttttttgttttttttattgtatgtatagatttattattttttttttttttttgtttttttttttttttttttttttttttttttttgagtgttgggaatatatagtatggggttttttaaatttgtttttgaaattttttaatatgtgtgtatgtgtgtttttttgtttttttaaagtttttttgatggtaggggataagtggttgttagataagtttggtaggggttagggtgtggaaagtttattttttttttatttatggattattatagtttttttgtgatgggttgtttagggggtttttagatttttgttagggaatattttgtgtggatgttttagttgtatttttggttttttttttaggatagattttgggattggggttgttgagattagtatagatattgagaggttttggatattgttttatattttttttatagttgttttttagttttatttttattggtagtttggattttttagtttggtagaaagttgggggtagtattttattttttttagagaaaagttttgtttatatttaaggttttattgattttatttaatgttgaaaatatttatttatttagttatttttttatgttatggtttaaggtttagatgtttagttttaattaaaatagttatagaggttattgtggtttgagggttttttggattttaggtttgtgtagatattatatttggtaataattaatttatggagtttattatgtgttagattttttgtgtttttgtgtgtttttatggtaattttgaagttagggatggttgttttttattttataggtgagaatattgagggtgttttagagagttgtgggttttaggttttgttatttgggggtgtaaaggtgttgttttagtagtttggttgtttgttatttggttgtttgttatttaatggggtaaagttttagtattattttgaaataaggataagttttggtttagaagttgggtagttaggttttgtgtttgttttttttttatatgtgttttgggtagtttattttttttgtttgtgaaatgggagagtagggagttagagatagttttttaggtttgtggtggttttgagtatagtgggtgtagatatttagtgttgagttaaagagagagagaattttgttagatgggttagtttattataagtagttaagtttggtttttgaggggttggagtgggtaggtttttgattaaggttgagttaggagggatttgatggttttagatggaggttggtttattttgttttagtagatgggaggttattttttaattttataggaagaagaggatagaaatgattgtagggggttaatttaggtttttggggatgttttttgtttgtatttttttttttttataatttagagagttatgtgggttttatttggagttttttgaatttttttggagttttttgtagattatagttggagttggtagggtttgagtggtttttgtttgttaggtgagggatttagagtttagagaagtttgattaggattggttttttttgttttttttgttgtgtgtttttattaggtgaggttgttttttttgtttttatttttttttttggggtgatttggggaggttttatttttttttgggttagtttttttatttgttagataatgggattttttagatattattgaggttttttttagttgggaaatttttttttgagttggggttttgattttgttatattagttttggatttttggaggttttagttttttagaagtatttatttagtggataggagtttgtggtaggtgtttggggatttttaggaagaggaaggattttttggttagagataagaagagtagtgtgggtaggggttaagtattttttttttgtagttttttttagattatgttattaggtggtttttggtttttttaaaaggagtttttgaaaagtttgtgtttgttgtagtaggtgtggtttgtgaagtgtgtgtatgtttgtgtgagggtggtgtgtgtttatatgtatatggtgggggtgggtatataaggtgggaggtttaatatggtggtagggatagattttggttgttgagttgggatagtttgtgatagaggttttagtatatttgtaggttttattagaaatttttagatggtgttggtttgatttgaaggtgggtatatgtagggaaggggtatatgtaggataggggtgtatgtgggggagggttatgtatagggtaggggtgtatgtggaggaggggtatatgtaggatgggtgtatgttggggagggttatgtgtaggatggggtgtatgtggggggtgtgtgtaagatagaggtgtatgggagagaagggtttgtatatggtaggggtgtattgggggtgtatgtagggtaggtgtgtatgtgggggaggggtatatttaggataagggtatatgtggggaggttatagggtttaaatgttgttagggtttttgggaagttgggattttagtgaatgtttgaggggagttaattttgtttgatttttttttatgattgtttatttaaataatattgtaaattaattatattaattgaatttatttttttgttttttgttgtttgtttttgtgatataaataatatgagtataatgaaaaattttggaaaatatagaaaatatataaaaaatgttaaagtttgaagttttataattatagtgaatattgtgagtgtttttgaggggatgggggtttgtaggtttttttgatataattatatttatttttatatattggagtattttttatgggtggttgtggagttgagtattttaggtttgttttagtgaattttttaatagtttgagagggaggtattgttattttttttattgtatggttgaagaaatagtaaaaaggaggttaaatattttttttagggtgtaagaagtagagttaagatttgaatttaagtttggttaaatggaaagtgtaaattgtttagtgtttagggttgtattttagttatgttttgttttttgtgagtagattatttatttatttatttttttaggagtatttattgagtattttttgtgatttagattttgtttagtatttatattaaggatttggtggatgtgaatgagatagagagaggttttaatttgattttttaagtggttataaattgagttttaattttgattatagtttgatttttagtttaagttgttattgatttttattggtttttattattgattgaattgtgatttggttttttgtattttgtagtggtttttgtgagttttttattttttgtgatgtgtgtgaaagttaaggttagtagtttattttatttagtttattatttatgtggtttgggttagggaggttgttaggagtttatttattatttttggtttgttattttgggttaggtttttttggagtgggggtttggttttggtttttggtattttgtttggtagaagggtgggttttggtttagagtatggggttattttaggaggggttagtatagttgagtttagggtatttgtgggtggggtttttatgttttagggtttttatattgtagttttttttttttgtttgggttttggaattttaggagattttaggagttgttgttttttttttttatttgtagaaatttaatagggtagtttatttgagtttttttgatgtttgtattgtatttttgggggttttgtatgtttttttaatttttaggtagggttagttatttattttataggatttagtgtaaaaagaaaatataggatttttttttaaaatgtaggaataaaagtttttttttttttttgtggatttttaatttatggtggtgttttttatttgttgtttaatgttatatgtatttggatttggggagatttgtgtagaaagtgtagatttttatagatgtttaggggttattttaaaatttggtgtgtagattttaattttttttttttttttatgtttgttttagtggagggtggtagtgtaggtagtgggttgttgagaatttatttttggaggtagtaggaggtagattggatttgggttttaagtttttaggtatgttgtattagtttattaggttttatttataatatattaatttagagtgaaaatgatttagtattttaatatggtaattgttgagtgttaaatttaagtataggaggtgggggggttaggtagttttggaatatagtagttttataggtggttgggtgtggggtggatttttgtttttggagtagagggatgtggagtatttttttttgtttggagtatttggggtatttggataagtatagggggttatgaatagggttatgtttgtgtgtttgttttttgtttagaagagggtatttgatgggaatattagggtatatttgtattatgtttgggtagtaggtttgggtatgattttggattaggtagatttgtagtaggtggaagggttttaggagagttgaggagtttaggggagaggaatttagaggtttttgttaaagtgtttgatgtgttgttgtaagaagggtagtataggttgggtgtggtggtttatgtttgtaattttagtattttgggaggttgaggtgggtggattatgaggttaggagattgagatttttttggataatatggggaaattttgtttttattaaaaatataaaaattagttggttgtggtggtgtgtgtttgtaattttagttatttggaaggttgaggtagaagaattgtttgaattagggagttggaggttgtagtgagttaagattatgttattgtattttagtttggtaatagagagagattttattttaaaaaaaaaaaaaaaaaaataaggtagtatgggtgtttgttgagagagagagaaagaagttttttttttgtatgtgttgttatgggattttggtttagttttttggggtgttttttgagtttagttttggttttgtttttttttttttgtgttttaatttttttaattatgtattgagtaaggagaagattattatattttaagtattttttgtatgggttatatattgagttttatgaatttttttttttttgttttataaatgattattggtttattttttagatgaggaaattgaagtttagaggaggtaatgatttatttagtaagaaggtggtggagttggttttgtttggtttttttttattttttgagttgttttagtttttttaggtttgggtggaggatgtgggaattaagtttgtgggggtattattagtttttgttagaaatggggttaagagaagattaaggatgttttttgatttgaggaaatgtttattaatttatagttattgtgttttggtgagttatgtaggttttggatgtaggttgtttgggtgggtgatttgagtagatgttttaatttttttggggtttagtttttttatttgtaaaataggttttataagagtttttgttttatagggttgtgaggattaaatgagttaaggtatattatttgagtttgggaggtagagattttagtgagtaagattatgttattgtattttagtttggaagatagagttagaatttgttttaaatatatatataaataaaatgagtaaaggtatggaaaatatttagatagtggttgatatagagttaagagttatgtaaatgtttattgttaatggaattatttaaaagttgagttataatttatattttttagattgttaattatgaattgatttattttaatgttgtgttttttttttttgtatttaggatttagtaaatttttttttgaaattttaatataattttttaggtttttgagaagataatttttttgtttttatagtgtttatagtttatggtggatttaatagttttttttagagtagtttttttaaaagtggattttgtatatattagttttttttagatgtattattttattttaagagataatttaataaatagttgagtatatattattttagatttttatggtttaataaggtagttattagtatattaaagattttgataagttttgtagtaaaatattattgaatattgtttgaaataattaattttaattttgtttgattatagagttttattatttttgtttaatagttgataatatttgaatatatgttgggagatgttatttttattttttgttttttaggaaatggtaaggggagttagagttgtgaggaatatttttttgtagggatgagtggttttatttttatagaaattatttttagttatgtgtattattgttaggttattttttttgtttttattttttttgtttgatttagtttttatagtggtttggagaggttattagtattaatgtttttattatatagatgaggaaattgaggtttataaaggttaagtgggtatatagttagtaagtggtagatttggtagataaatttatagtttttgattttaaattttatatttgtttttttgtatgttgattggaaaagtaaaaatagattttattttaataggattaatttttttttattataggtttttaaaaaatttaggtattttttttttttggtagtattgaatgttttaaaaatttaaaatttttattattttttttttgattattaaagtagtatgtgtttgttatgtataaaattttttaaatattttgagttgaaaaatgaaaaaaaggtagggtgtggtggtttaagtttgtaattttattattttgggaggttgaggtgggtggattatgaggttaggagattgagattattttggttaatatagtgaaattttgtttttattaaaaatataaaaattagttaggtgtagtggtgggtatttgtagttttagttatttgagaggttgaggtaggagaatggtgtgaatttaggaggtggagtttgtagtgagtgtgattgtgttattgtatgttagtttgggtgatagagttagattttgtttgaaaaaaaaaaaaaaaagaaaagaaaagaaaagaaaaatgaaaaaaaaaaaaaaatagatttgtatagttttataaagtagttattagtttttaaatgaaaatatttaaatgttatttaaatgaaaatagttaaaatgaaataagataaaaaatttagttttttagttatagtagttatgttttaagtgtttgggatttatgtgtttttggtggttattgtgttgggtagtatagatatgggatattattattattatagagaattttatgggatggtgttgttttagattttttttagatatattttaatatttatataggttgattatttttaatttaaaaatttaaaatttgaaatgttttaaaatttaaaatttttttagggttaatatggtatttaaaggaaatgtttattggagaattttggattttggattgaagtataatttaattattttgaaatttgataaaattagaagttttaaatttgaatgtttttggttttagttattttgggtaagggatgtttaatttgtaatgattgttaatgtgtggtttttttttttggagattaggttttgttttgttgtttaagttagagtgtagtggtatgattatagtttattgtagtttttattttttgagtttaagttatttttttgttttagttttttaaagtgttgggattataggtgggagttgttatgttttagtttattgatatttttgttgaggtttttagatatatttgtatggttttatatatggaggaaagagatttatagaggtaaaaataagatatggggtaaaaatagattggaaggaaatatattgaatgatagtggttttttttgggtgttgagattattgagtttatttttaaattttttagattttttaggtgttttataatgtaaaatgtagatagggtggggatgttggttggagttatgttttttttaatgtttttattggttttaaaatttttaagttatgtttttatttaaggttttatttattattattttaatattgtggatttataaagaatggaagtttatataagtttagggaaggaaggaaaggtagatagaggtttatttttaggtttgggtagttgtatagggttttttgtttagaagggttttatgtttggttttgtgttttgtggttgttgttttgaaatttttattgatttttgaataagggattttgtatttttattttgtattgtgttttgaaaattatgttgttgttattagttttgggattttttttaggataggtttttttttagttgttttaagtttttgtttttgtttttgtttaattatggatgtggttatttatggagttttttatgtgttttagagtaagtgtgttttggttgtttaggtgtgtgtttagagattgataaaaatagggtttgtgagtgggtgtgggaggtttttgtggtttttgtttatatatgtatttatttttaaggttatgtttatattggtttattttagagaattgttttgtgtattatgggatgttttgttttatattatggtttagtttggtttagttttggagttttgtgttttgaagttatgattaattttaggtttggtttatttttttttttagtttttttttttttaagttttttataggatttataaattttttatttttatgtaatttttttgtgtgattttttttttatatttttgtttatgttgtttattttgtttgtattagtaaggtttttttttttttagatttgttttttttagatttattttagattttattttttttagaaagattttaggaagtatttgagaagggtttgaagatgttgtggttgtatagaggaggatatgaattattttgtttagaggtattggggagggttttatggaggtggtgtttttaggttaaggaagagaagatattttttgggtagaagggagagtttgatgggttggtttgatgttagatagattataggatgatttaaggtttttttttttttttttaaatattagttgtagtaagttttattatttgtttgagtttgtttttatttttataatggaggtggtgatgtttagtatatggagttgtgatgaggatttaatggggaatttagagtatttatggaagtgttaggaggttaagattttgtataggtaggaaggatttaagttagaggggtgtgggtggttagaggagagagtttattttagtagggtttggtaggttaaggtttgggttgaattttgaggttttggagtttagaatagtatttgtaattttttggttgttggggtttaggtaaggattgttttttttttgagtgttagtttttttatttataaatggaaagttgggatattgaaaaatattgggggggagggtggtttttgaggtagtttttttttatatattataggaatgtggtgttttagggagaaggtatttttgtttattgtgtttatttttgtatttttagtgtttagaatagtgtttgtatgtagtagatgtttaataaatgtttattgaatgaattagtagtaattaatttgtttattttatattttaagtttgttggggatgtaggtttatttttttagggaaattgtttgtagattgggattatattttaggttataagtattttttgagtatttattgtatgtatggttttgtgtagtttggggtagatttttgttttatagtttgatagggtagagttaaggaggtaggtgatagatatagtgatttgggaagaagaatagagagtagggtggttagtagggttttgtttgggtgggagtaggttgtttttaggttggagtttaggttgatgggagttttagtttgtttgtttttgggagggtgggattgtttttttttttttttttttttgaaaataaaaattgtttttttttaaatttataagtattaaaagtttggaaaatatataataattaaaagaatataaaataaaggttatttgttattatggtggattatatagtattaattattatggattttttagtgtttttttttagttttttttttgaggtggttttgtttttagaggtggttttttttttttttgggaagggatatagttgttttgtaggagatgtgggggtattaggttttttttatgggttttttattatttttgatttggaggttttttttttattttttttggatttagtatttttttttgagatataggggtgtgaagagttgggggaggtatgttagtaggtttttttttttgtttttgtttattttatggaggtggggtgggatagaatttaggtttgaggaaggagtattggaggttaagttataggtgttggtttttagttttggtgtttaggtaagttgggtttgggaataggggtatgattaaaatggatttttttttttttttttatttttttttattttatttgtttttttttttgtgttttttaagtgttttgttttttagatgttttttgttttttttgttttagttttttaattttttttaataaaggttaaggaattaggtagattgtggatatttaggtgtgtatgatgggaagggatttgtatttataaaagtttttttttatagggattgtatgtgttggtggaattttagttattatgttttatgttgaaggatgtttggagggggttgattttggttattttttaaattataagttatatgtgtttgttttttttgtttatatgtaagtttgaattttttgttaaaaatattttttttagatttgaaagaaaattttaaagaggaatttaaatttttatgttgtttgtattgattggattggagtgtttaggtttgtgttaataagtgttttaaagaagaagttagatagtgaagggggaagtgagggagaagttggaaaatttttaggttgattaattgttagtttatttatttgtttatttatttatttatttatttatttatttatttatttatttatttatttttttttttttttttttatttatttagtgagaagggttgaatattatttgtgagtttgtttttgtttttaagaatattttttggatatttgtggggtgagtagtgaggggtagtaatggtagagtatttttattgtttggaggggagaaagggaagggttgggaaggttttttaagggggtggttatgaagttgggttttgagaagataggttagggttttttattttttatattttgtttagagttagatagaaggtttttgtagaggaggaggaatattaaatagtagtaatttttggtattttatgagggtttgtttgtgttgggttttgtgttgtgtatgtgatatatattattttattaaatttatttaatatgttttgagggggtgttatttattttttttattttataggtaagaaaatgaaatatagagaggtgaggtattttttttaatgttatatagtgaggaagtggtagagtttggttgtagttgaggtttatagttgtattttatattgttttttttttgaagagtgtttttttttatttttgggagttattgataaggggtttgatagtttttttagttttgtgtttgtttagttttttttagttttgaaaaaattagggtttggtgttggagaaagagtaggagggtgagatgtggaaatatttgttgagtggtaggggattatgttggtgtagaggggtttgagttgattaggaggttggtttgtgttaggttagtgttttttgtgtattaggtgttatatgtggggtttagggtagggttatagttgttttttttaattattttttgaggttagtgttattagtttattttatagaggaggaaattgagattttaagaggtgaattaatatgttaggttatttagttattatgtagtttaagtttagattgttttgatttttaaattgtgtgtaaggtggatgattggattttagggaggtaaggaaagttagtttttttgttgttgaatttaatgttttataagattatatatttttttagattttagttttgttatgtatgaaatgaggaggggaattttttgtttttgggttttgatatgtttttggattgatttattgttttttgtttttgtgattttttaaagtaagattagagttttatttttagttttaggtttgagatttttatttttattgtgtttaggggttttaggaggtgttattttagggtagatggtaaaggtttgggttgtagatttattgagggttaaaggtaattttttttttttttattttttttttttttttttttttttttttatttttattaagtaaggtagggaattatttgttgagttttagggtaggtttatggattgaagtttaggaggatagggttttttagtggttgtaggtgttttagtattgatttttagtagagggggtgtttgggtttagtttggaagattgggtgagattttttaattatggggggtgggggtatattttgggtggtagatttgaggaagagtttgtagataaggtatttttaggagatggtaataagagttggtgttggggttgttttattgaatttagagtttaggtttgtttttttatttatggaggagtttggattggtttagtggtaaggttggggttagaggttgttattttttttttgttttttatagtttgttggaaggttaggtttttaggttttgtttatttgttttttggttttttttttttaggtaattgagggagtttttgttttgatgtggttatttttaggtttaggtgttaatgagttttttatatgattagtggggttgttgggggtttttagtttgttagagtgggtgtggtgaggtttggatatatagttttgttgtgtggggttggtttatgtttgtttagattttgtgggtagtggggggtttttaggaatgtttttttagtttggggggtattttggataggtagggtggtttggggagatgggtgtgtgtagggtagttttagaagttgttattaaagggatttagtagatgtggtgttaggtaagtgttatagtgggtatggaagggttggtggttagtttgttttttttttagggatggtggggagggggaggttttatggatatatgtgtttagggtgattagttattaggggttgtttgggatgaaggggttttttgggatgtggagtttttagtgttaaaatagagagttttttgttattggaattttttggatttttggaaaggatatagtgattgatttttttggtttgggtagttttttttttgtttggtgatttttgagttagattattttggttagatttgtttagggttattttgtttattttttgtttttatataggtttgttttatatttaagagtttattttttattttttttaggtatttttaggggaggagttgttggttaattttaattattgttagggggattttggttagatttatattatgtttttagttttttttgtggtttttgagttagtttatatttttttgtttttatatttttgtttaggatgttttttttgtttggaatattttttttttgtttttgttatttttttatttttagggatttagtttttaagttatttttttagaggatttgtttttttttttttaaggttgggttagtatttttttttgaatttatagttttggttttttttttaaaaaatttttgttatgttttagggtaattttttgttgatttatttttttttatattagatggtgagtttttaggatggagattttgatttagttttttttgggtttttagtataaggttatgtttatggtgtttattaaatggaaaatgtttattgagtaattattttgtgttaggtattatgtttttttaattttttttatagttttgtaaggttggtgtaatttttatagatgaggaaattagagatagagaagtgaagtaatttatgtaggtgatggtagagggtagagttaggatttgaatttggagagtttggttttaaagtttaagttggaattttgatattttatattttgataagtttttgggaaatgattgattaaatagatgaatgtgtttgtttttttgttgttttagagtttttttaaagtttatatgtggtagtttgggtttatttttttggtttttttttttggaggggtatttattgttagtgtttttggtgagtgtttgtttgtgggggtataagtgagggtttagtaaaggtgatttggtgtgaggggggggtgttttagggggtgtagaggagggttttatgaggtagatttagaatgaaggttttggtttttagtggaattgtgtatgggtaaggggtttttagggttattggtttataattgttagatggggaaattgaggtttagagagaggaagggatttgtttttagttatatagagtgtttggattatagtttttaggttttagtttttttatttgttatatagggagaataaattttttttgttttgtttgggggtagattttagggggtttttgtgtttttttatattttttattttagtttttagaattttattatttatgtattagttttgagggtaggtgttgttttttttttattttttgtttatgtttttattgtaggatgggaattaaatgtttttttattttttttttatattttttttttttatagtgaattgaggggagtttttgattttttagtttaaagttagagaaattgagaggggagggttgggtgggagttgtgggaatgttatgtataagtagttggattttttaggggtttggattttttttttgttgttttgaaggtttttgtataggttgtggtattggttgagtataggtgtttgaaggtagaggtatggatgggatgttttatttttagtttgtttttgttagtgaagataaaagggaagttattttttgttggtttatggggattttgaggtagtaggagtttggtgataattttagggattattttgggttgttaggtgggggagatagagaagtttatataggaggtattaaatgtaatttatttgtgtttttttatttatgagagaatatggatttagagatgttaagtgatttagatatagttttatagtatataggtggtagaggtaggtaggggattgggtttttttggtagtagtttttaagtttgtttgagaggtatattagaattgttttaggggatttgtaaaattatatttgtttaggtttaaattttagagattttgattttgtagtttgaggtaggaatggagaattttttatagtttgaggtaggaattgggaatttagtgtttaaaattttttaggggtggtgattttagaaaatttgttggttttattatattttgtttagggattgagatgggatggtatttggaagatataggtaggaggaagaggaggtagtggggggtatagggagatttttttttttttggtaaaagtttgtggatgagagaatagtttgagtaagattttgagaatttgagatttggatggatttggagtttttgttttgtgtataatttagggggtttgtgatattgggttggagataattgtgttttttttttttttggtttttagttgaaatttagtattatattttatggtgattttttattagtggaaattataggtgttttttggtattatagtggggttagggatgatttgaaatattgtttatgtttattataattgtatggtttattgtggggttttgttatttagtgagtttttgaagaggtatagataaatggagtttaataaatggaaaatgtgagttaatatgttattagtttgttttttgagtttgataatggtatttttattgatttttttttttttgtaattttttggattttgttttatgtgtttaaaaatgtaattttgaggaggaatttgaaggttttttgagattgttaagggttggtgggttagggattttgtagggggtagtgtggggttggtattttgtaaatgggattttggggttgtgtttttttgaggaaggaattggtagttggagttttgtaagtttttagggatgggatttgggagataggtttttatggtgagtatgttgtgagtagaaatgaataggagagagaaggttgaagaggggagataggtttttataaaagtggagggaaggtttttgggttatagattttagatttaaatatttttatagattttagtttatgaggtgttttttgtgttattgttggttaggattagtttgttttgtttagtggttttttgtttttgggtgtatatatgatatgttgggttaaagttatttttttttttgtgttttttgtgttattgttagttattttttaggttttgaggattaggatttagtttaggttgattggggttttagttttgttttttaaggtttttttgttttaaattttatatttttttattttgtgtatggaaggagaaatatagattataaagatttggtaaatggattttataaatttttatttttttgttatagaattgtttttaattagttttgaggattataaagggaataatgttataatagtagtaattttaaggaagtagttatagtttttagtttttagatttggggttgttgtttattattagttatagttaggtttgatgggagtgtttttattttaggggatagtaggttttttttattttttgatttagtttttatttgtagtagtatagttttttttggttttattagggaagaagaataggttttgtttttagataagtttttttagaagtttgaggatttaaatatttaaatgtgtttgggtttttgttttgagttggttatttaggtagtagttttgaattatttggttagttagtggtagggtaggttaatgggttggagggtaggtaggtaggtagatttatttttgtatttttgttgattgttttggttgaggaaaggtagtattagtttttaattttgaagttttagattttatgtagtttttttgttttggaattatttagaggtattgtttttatatatggtttatttttaggtttagataatgagaattttataagtagaggggattttatttggggtatagagaggttaagtaattttttttttaaggttttttagtaaggaagttattgagttgtgggatttgagtttagggatttttgatttttagttttaggtgttatagttttatttgggtttttgttagggaggaggaaggtagtagggggtgtttgaggttagggtgtattagttttaaatgttagatagaggtaggagaagtttttttatgagttttagttttattagaggttttaggttggggattttagattttttatttttgttgggagatataatttagaattttgtatttttgtagttattaaaaaaggtaaaagttgtttagaaatattttttttttttttgtggttaaatttatgaatttttttgaggtttgtttttttgttttgtgtaggtttagttttagtgtagtttagttttgtgtagttttttataaaagtttgtggttttttttttttttttttgtttttgatattttaggagttatatataaaatgttggtggtggtttttaggaagatttttgtattttatagttttttttagaagttgttagtagtgattttttgagtttaggtggggagttttaggtaggataggggttggggttgtaggttttggggttttgttagtgaagtagtaagttgagggtttttgagagttttttttggtttttttgagggttgttttttgaggttttgaggttttggagtatttattgtttttatggtttattgtttttattagtggaggatgaaagtgttatagtgatgttttatgttaagagattatagagattattaatttttttttttattttaggtttttagaggttagtggatttaggtggataggttgtgtgtttgagggtagttagggtggttagtggagggatgtggtttggggtttggttatagttttttatttagggttttgggttattgttatttattgtggatgaaggttggtgagtaggttgggaaggagttgaagatgttgtttgatgttatgttttgttttgaagaaggtgagaatttttagttttttagggggttgggttgggatttatttggttggttgttgttttattttttttttttttagttatttttgaaaataaaaggggggggtgttgttttttgttgttttttgttttgtttttgtttttttttttttttttgttgttatgaaaaagaaaaaaggaaagaatgtgagagtgtgtgtgagtgagagagagaaaaaaatttttaaggaaagtaagtttttgtttgtatttaagaatttggatttttggttttataggaatgtttagttataaatttttaatagaagtgtatgtagagtgtattattagatggtgggaaggggtttttggtagttagggtggaggagttttgaagttgatagagtagagtgggttgtttttagtgttatggggaatgaatgaatgaggtttatttttgatagagtttaggttttggtgggtatgagggtggttgggggtggggagtattaggagttaattagtttttgtgtagggttttggaggtggtaagggtttggttttgtggttttgtggttgagggattaggtttttttagtgttaatttaattttagtttataggatgtgagaagtttgtttgtggttttggtttattggttgggttgtggttatttgggttgtgatgttatggttttttagaagattttgtggttgtttttttttttggaaaagaaaaaaaaaaaaaagaaagagagagagagagagaaatagaaaagtgatggtttttatttgtgaggttggttttagtatgtggtttaagaaatagaattgaaagtggttgtagtgggtgtggttaggagggtggtttggtttttgggtgggagatttttttttaattaaggttagtattggtttgggtgggttaggagttttgtgggttttttattgagtgtttagagtttggatttattagtggttggagagttttttgttatgttattttgtttttgggttgtggttgattttttgttattgtttattattattgttgttagggagaggtgtttatatgtgtggttgggtggtatttttggggtttttatgggagttgggattaagtataatgggaaatatatgaagtggtattgttagtatttatgtttggttttggtttgtttattgagaagggtttttttgtggaaatttggtggtttgtttgtattggggggttttttgtagggttgggggttgagtttttagtatgttatttagggttttttattttttttgttgttatttgtgtatttttttgggggtttttgttttagtatgatgtttgggagtttttttgtttttgggtttttgtttatgttgttttttttattagaagtgttttttgtgtttttatgtttttgaggagttaaggtttagagaggtttaaaagtagaaaagttatgaagatgattgaattttatatttgtatgttttttaaagttatgttaggatgggagagagggtggagagtgggggaaaggtggtggtttttattattttttttgtaagttttatttttttattttataggttaggttgtgaggtttagggtggtgatgttagtttgtttaaggttatgtggtattttggaatgggattggaattttagtttttgatttattagttttgattttgggtatgatattagagtgtttttttatgttttttaaatgaagattttagaaagtttttttgtagtttggttattaatttttggttttttttagggattttaggtttggggttagaatttagtattagtttttgatttatagtagtttttgtaggttaataaggatggggtggggatatttttggaagaggatgggttggtttaaggttttaaagagatttgtttttgtttaaggtatatgtgtagaagatggttttggaaatgtttatttagttttattttaagttttatgaagatttagttttttgtttttgaatggtgggttaattggtgttgagggtgggggtggtggggataagagttttaatttggttagagaggaagtaggtttatggtgatagttatagagttttagagttagatttggtttttagttttagttttgttgaatttgagtagttagattttggggaaagttattttttttttttgggttttagtttttttttttgtaaaatggggataatattttttttaaagggataggtatggggtgagggtattataaatattggtttttttggttgagtttttatgatgtaatttgggttttgttatgagttagtttaagtaaggagttatgatagttatgtagggggagaggttgttttgtttttattttgtgttgtaaatttattagttggttagtttgtatgggatttttaggggtta

SEQ ID NO: 251 - DNA, 67667 bp, Artificial Sequence
  Chemically-Treated DNA
tgatttttgagggttttatgtaggttggttagttgatgagtttataatatagggtgggggtggggtagtttttttttttgtatgattgttatagttttttatttgagttgatttataatggagtttaaattgtgttatggaggtttagttaaggaaattaatgtttatgatgtttttattttgtgtttgtttttttgaagaaggtgttatttttattttatagggaagaaaattgaggtttagagaaaggaagtgattttttttagggtttggttgtttagatttagtagagttggggttggaagttaaatttgattttagagttttgtggttgttattataaatttgttttttttttggttaaattagaatttttgtttttattatttttatttttagtattaattgatttattatttagggatagaagattgaatttttatgaggtttgagatgaggttgagtgagtgtttttaaggttattttttgtatatgtgttttgggtagaaataagtttttttgggattttggattagtttatttttttttagggatgtttttattttatttttgttggtttatagaggttattgtgagttagaggttggtgttaggttttagttttaagtttggggtttttgggagaggttaggggttggtggttaggttgtagagggattttttgaagtttttatttaaagggtatggaagggtattttggtgttatgtttaaggttggggttggtgagttagaggttgaagttttaattttattttagaatattatatgattttagataagttggtgttattattttgggttttgtagtttggtttgtgaaatgggagagtagagtttgtaagggaaatggtaaaagttgttattttttttttattttttatttttttttttattttgatatgattttggggaatatgtaagtatagggtttaattgtttttatgatttttttatttttgagtttttttgggttttgattttttaaggatatgaagatataaagggtgtttttggtgaggggaatagtatgagtgaaggtttggaggtagggaagtttttgagtattatgttggggtagagatttttaaggggatgtgtaggtggtaataagaggagtaaagggttttgaatgatatgttggggatttagtttttagttttgtagagggttttttagtgtgggtaggttattaggtttttataggaaggttttttttggtgggtaggttgaggttaggtgtgagtgttggtaatgttattttatgtgttttttgttgtatttagttttaatttttataaaagttttagaggtgttatttagttatatatgtggatatttttttttggtaataatggtggtggataatggtagggagttagttgtagtttaggggtgaggtggtatggtagggagttttttggttgttggtggatttgggttttgggtatttggtgaggggtttgtggggtttttagtttgtttaggttaatgttggttttaattaagaaggagttttttatttaggagttaaattatttttttggttatgtttattgtaattgtttttagttttgttttttgggttgtgtgttgaggttagttttataaataaaagttattatttttttatttttttttttttttttttttttttttttttttttttttttttaaaaagagaggtagttataagattttttaaaaggttgtgatattatggtttaggtgattgtggtttagttaatgagttaaggttgtgagtaggttttttgtattttgtgagttgaggttgggttgatattgggaaggtttggttttttaattatagaattataaggttaggtttttgttgtttttagggttttgtgtgggagttggttggtttttggtgttttttatttttggttgtttttgtatttattagagtttgggttttgttaagggtaagttttatttatttattttttgtggtattggaggtggtttattttgttttgttagttttggagtttttttattttggttgttgaaagtttttttttgttatttaatgatatattttgtatatgtttttgttgagaatttgtggttagatatttttgtgggattgggaatttaaatttttgggtataaatagaaatttattttttttggggattttttttttttttttatttatatatatttttgtgtttttttttttttttttttttgtagtagtaggggggaaaaaagagataaaaataaaataaaaaataataaaaagtaatattttttttttttatttttaaaagtagttagaggaaaaaaaaataaaataatagttaattaagtgaattttaatttaattttttgaagggttgaaaatttttgttttttttagagtggggtatggtattgaatagtatttttgatttttttttgatttatttgttgatttttatttgtggtgagtaataatagtttagggttttgggtggggagttgtggttaggttttggattatgtttttttattgattgttttggttgtttttaagtgtatagtttgtttgtttaaatttgttggtttttgaaagtttgaggtgggaagaggggttggtggtttttgtggttttttggtgtggaatattgttgtggtatttttattttttgttggtggggatagtaagttgtgggggtgatggatattttaagattttaagattttaaagggtagtttttagaggggttaagggaaatttttagggatttttggtttgttgttttattaatagggttttagggtttgtagttttagtttttgttttgtttgggattttttatttgggtttaggaggttattgttggtaatttttggggagagttgtgggatgtaggggtttttttggagattattgttaatattttgtgtgtaatttttggggtattagaagtagagggaggagaaggaagttataggtttttgtggaaaattgtatagagttgggttgtattgaagttggatttgtatggggtagggggatagattttgagaaagtttgtggatttggttatggaagaggagaaagtgtttttgggtagtttttgttttttttggtggttgtagggatgtagagttttgggttgtgttttttagtaaggatagggggtttgggatttttgatttggagtttttaatggggttgggatttatggggagattttttttgtttttgtttggtatttagggttgatgtattttggttttagatattttttgttgttttttttttttttagtaggagtttagatggggttgtgatatttgagattggggattaagagtttttgagtttaagttttatggtttagtggtttttttgttgagagattttaggaggggagttatttaatttttttgtgttttaaatagagttttttttgtttgtggaatttttattgtttgagtttgggggtggattatgtataagggtagtgtttttggatggttttagaatagagaggttgtatgagatttagaattttagggttgggggttggtgttgtttttttttagttgaggtagttagtagagatgtagaggtgggtttgtttgtttgtttattttttagtttattggtttgttttgttgttggttgattgagtgatttagggttgttgtttgggtggttggtttggggtagggatttagatatatttgggtgtttgagtttttaggtttttgggaaggtttgtttgagagtggggtttgttttttttttttggtgaggttaaggaaggttgtgttgttgtagatggggattgagttggggagtgaagggggtttgttgttttttgaaatgggggtatttttattaaatttagttgtagttgatgatgagtggtagttttaggtttgagagttgagagttgtggttgtttttttggagttgttgttattataatgttgttttttttgtagtttttggagttaattaaaggtagttttgtggtaagaaaataagagtttataaaatttatttgttgggtttttgtaatttgtatttttttttttgtgtgtaagatggagaaatgtagggtttaaaataaaggaattttgggagatagggttagagttttggttggtttgggttgggttttgatttttggagtttgggaggtggttggtagtagtataaagggtataaagggagaggtggttttggtttaatatgttatgtatgtgtttagagataggaggttgttgggtagagtgggttgattttggttagtagtggtatagaaggtgttttataggttagggtttgtggagatgtttggatttggggtttgtggtttgagggttttttttttatttttgtggagatttgttttttttttttagtttttttttttttgtttatttttgtttatgatgtgtttgttatgggggtttgttttttaaattttatttttggaggtttatagggttttagttgttaattttttttttaaagagatgtagttttagggttttatttgtagggtgttaattttatgttgttttttatagggtttttaatttattgatttttggtagttttagggaatttttaggtttttttttggagttgtgtttttaaatgtgtaagataaaatttaaaggattataaaggaaaagaaattgatggaaatattattgttaaatttagaaagtaagttggtgatatattgatttatgttttttatttgttgaattttatttgtttgtgtttttttaagaatttattgagtgataagattttgtggtgggttatgtagttgtgatgagtatgaataatattttaggttatttttgattttgttgtgatattagagaatatttgtgatttttattggtggaaaattgttatggaatatgatgttaaattttagttagaggttagggaaaggaaagatatggttatttttagtttagtgttatagattttttaaattatatgtaagataaaaattttaggtttatttgggttttgggtttttagaattttatttgggttgtttttttgtttataggtttttattagaaggggaagggtttttttgtgttttttattgtttttttttttttttatttgtgttttttaaatgttattttattttagtttttgagtaaagtgtgatggagttagtaggttttttgaaattattgtttttagagagttttaaatattggatttttagtttttattttaggttgtggaggattttttatttttattttagattgtggaattagaatttttagggtttgggtttgggtaggtgtggttttgtaaattttttaaagtgattttgatgtgttttttaggtaggtttggggattgttgttagggaagtttagttttttatttgtttttgttgtttgtgtgttgtgagattgtgtttgagttatttgatatttttggatttgtgtttttttatgagtaaaagggtatgagtgagttgtatttggtgttttttatgtgggtttttttgttttttttatttgataatttagggtggtttttagaattattattgagtttttattattttagggtttttatagattaatggaagatgattttttttttgtttttattggtaaaaataggttgagaatgaagtattttatttatgtttttgtttttaggtatttgtatttagttagtgttatagtttgtgtaggggtttttaaggtagtaagggagagatttagatttttggagagtttgattgtttgtgtatgatatttttatggtttttatttagttttttttttttagtttttttgattttgagttaagggattagaaattttttttagtttattgtggagagaaggggtgtgggaaaagggtggagaggtatttggtttttattttgtagtagaggtgtgagtaggaggtgagaagagggtaatgtttatttttagggttggtgtatggatggtggaattttagaagttggaatggaaggtgtgagagggtataggggttttttggggtttatttttaggtaggataagggggatttattttttttgtgtgataaatggggaagttgagatttaagagttgtgatttagatattttgtgtaattaaggataagtttttttttttttttgggttttagtttttttgtttgataattatgggttaatggttttgaggattttttgtttatgtatggttttattgggggttagaatttttattttgaatttgttttatgaggtttttttttgtattttttggggtattttttttttatattaggttatttttgttgaatttttatttgtatttttataggtaaatatttattagggatattggtagtgggtgtttttttagggagggaagttaaggaaatgggtttaaattgttatatgtaggttttaagggggttttggggtggtgggggggtaaatgtgtttatttgtttagttagttattttttaaaaatttattgaggtgtagagtattgagattttagtttgggttttagagttaggttttttaggtttaagttttgattttgttttttgttgttatttgtatgagttattttatttttttgtttttggtttttttatttgtaggggttatattaattttgtagagttatggagagaattaaaggagtatgatgtttggtatagagtagttgtttaataagtattttttatttgatgaatattatgagtatggttttgtattgggagtttgggggaaattgggttaggatttttattttaagagtttattatttggtgtagaaaaagatgggttaatagaaaattgttttggggtgtgataaaggttttttgggagaagaattagggttgtgagtttaaagaggggtattagtttagttttgggaaagagagaataagttttttggaggagtgatttggaaattgggtttttaagggtaaagaggtaataaagatagggaaaggatgttttaggtagaaggaatgttttgggtaaaggtgtggaagtaggaaagtatgagttggtttgggagttatagggagggttgggagtgtggtgtgggtttggttgaggtttttttagtagtggttggagttggttggtagttttttttttgaagatgtttgggagaaatggaaagtggatttttgggtatgaggtaggtttgtgtggaggtagggggtggataaaatggttttgggtaggtttggttgagatggtttgatttagaggttattggatagggaggaggttgtttagattagagaggttagttattgtattttttttgaaggtttaggaagttttaataataggggattttttgttttagtattgaaagttttatgttttaggaaatttttttattttaggtaatttttgatggttggttattttgagtatatgtgtttatggggtttttttttttttgttatttttgggagaggaatagattgattgttagtttttttgtgtttattatggtgtttgtttggtgttatgtttgttaggtttttttgatggtggtttttgaggttgttttgtatatatttgtttttttagattattttgtttgtttaaagtgttttttaggttggaaaagtatttttaggagttttttattgtttatagggtttaggtaggtatgagttgattttatatagtgggattgtgtgtttaggttttattgtatttattttggtgggttggaggtttttagtagttttattggttatatagagggtttattgatgtttgggtttggaggtggttgtattaaagtggaggtttttttggttatttggagggaggaggttgggagatggataagtagagtttgaaaatttgattttttagtgggttgtgagaggtaggaggagagtggtagtttttgattttggttttgttattgagttagtttggatttttttatgggtggggaaataggtttgggttttgggtttagtggggtagttttaatattagtttttattgttattttttggggatgttttatttgtagatttttttttaaatttgttatttagagtgtgtttttattttttgtagttggggaattttatttaattttttagattgaatttaaatattttttttgttaggagttagtgttgggatatttgtagttattggggagttttgtttttttgagttttagtttgtgggtttgttttgagatttagtgagtagttttttattttgtttagtggaagtaaagagaaggaaggaaggaagggaggggtggagggaagaaagattgtttttagtttttagtggatttatagtttaggtttttgttatttgttttaaaatagtattttttgaagtttttggatatagtggggatgggaattttgggtttagggttgggagtgggattttggttttgttttgagaagttataagaataaggaatagtgaattagtttaggagtatattagagtttggaggtagagagtttttttttttattttatatatgatgaaattgaggtttaaagaggtgtgtggttttgtaaaatattgaatttagtagtaggaaaattgattttttttgtttttttggggtttaattatttgttttgtatatagtttaggagttagaataatttaggtttaaattgtatggtagttgggtgatttgatatgttaatttattttttaaggttttagtttttttttttgtaaaatgggttagtaatattgattttaaagggtggttgggaggagtaattgtggttttattttgagttttgtatgtggtatttggtatatagggagtattggtttggtataggttggttttttgattggtttgggtttttttgtgttagtgtgattttttgttatttaatagatgtttttatattttatttttttgttttttttttagtgttaagttttggtttttttagggttagagagggttgagtaggtataagattagagggattgttagattttttgttaatggtttttagggataaaggaaggtattttttggagagaaagtaatgtaaaatgtggttataagttttagttgtagttaggttttgttatttttttgttgtgtggtgttgggagaggtgttttatttttttgtgttttatttttttatttgtaaaatggagaaaatgaatagtatttttttaaggtatgttgggtaggtttaatgaggtagtgtgtattatgtgtatagtatagggtttggtatagataagtttttatggaatgttagaaattattattatttaatgtttttttttttttgtaaaagttttttgtttgattttaagtaggatgtggaaggtgagaaattttggtttgtttttttaaggtttagttttatggttgtttttttggggagtttttttagttttttttttttttttttttaggtggtgggggtgttttgttattgttgttttttattatttattttataggtgtttaaagggtgtttttgggagtaggggtaggtttataggtgatatttagttttttttattgaatggatagaggaaagaaagaaagaatggatggatggatggatggatggatggatggatggatggatggatgaatgaatgaatgggttgatgattggttagtttgagagttttttagttttttttttatttttttttttattgtttggttttttttttgaaatatttgttggtgtgagtttgagtattttggtttaattggtgtaggtagtgtgaaggtttaggtttttttttggggtttttttttgagtttgggaaaagtgtttttggtaaaaggtttagatttatgtgtgggtggaaagggtagatgtatataatttatgatttgaagggtgattaaagttagttttttttaaatattttttaatgtgggatatggtgattgagattttattagtatatgtagtttttgtgggggggagtttttgtaaatgtaggtttttttttattatgtatatttgagtgtttatagtttgtttgattttttggtttttgttgagaggagttaaaaggttggagtagaggaaatagagggtatttgggggatggaatgtttggagaatgtaaagggaaaggtggatggagtggaaaggggtggggaggaaaggaggggtttattttggttatgtttttatttttaaatttaatttgtttgggtattagggttgaggattagtatttgtggtttggtttttagtgttttttttttaagtttgagttttgttttattttatttttgtggggtaagtaggggtaggaggggaggtttgttgatgtattttttttagttttttgtatttttgtgttttgggaagaggtgttaggtttagggggggtggagaaaggatttttaagttagaagtgataaagagtttatggagagagtttggtgtttttatattttttatagagtagttatatttttttttagggggagagaaagttatttttgagagtaaagttattttagaaaaaagattagagggaaatattgaaaagtttatagtagttaatattgtgtggtttgttatgatggtaggtaatttttattttatatttttttgattattgtgtattttttaaatttttaatatttgtaaatttaagggaaaataatttttgtttttagagaaagaaagaggaagaggtagttttatttttttaggaataggtaagttggggtttttattagtttgagttttagtttgggaatggtttgtttttatttaggtaaggttttgttggttattttgttttttgtttttttttttaaattattgtgtttgttatttgtttttttggttttgttttgttgggttgtggagtaagggtttgttttgggttgtgtagagttatgtatatagtaggtgtttaggaaatgtttgtgatttgaggtgtggttttaatttgtagatagtttttttggagaggtgggtttatgtttttagtggatttaggatgtgaggtgggtgaattggttgttgttgatttatttaatgaatatttattgagtatttattgtatgtaagtattgttttgggtattggagatgtagaagtgaatataatggataaagatgttttttttttggggtgttatatttttgtgatgtgtggagagagattgttttaggaattatttttttttttagtgttttttagtgttttagttttttatttatagatggggaaattgatatttagagaggaggtagtttttgtttgaattttgatagttagggagttgtagatgttgttttaagttttagagttttgagatttagtttagattttagtttattaagttttattaaggtaggtttttttttttggttatttatatttttttggtttaggttttttttatttatgtagaattttggttttttggtatttttataaatgttttggattttttattaaatttttattatagttttgtgtgttgggtattattatttttattgtggagatgaaaatagatttaggtagatggtgggatttgttgtaattaatgtttaagaagaggaaagaggattttgagttattttgtggtttgtttgatattaaattagtttgttaaatttttttttttgtttggaagatatttttttttttttggtttgagggtattatttttatggagttttttttgatatttttaagtgaggtgatttatatttttttttatgtaattatagtatttttaggttttttttaaatattttttgaagtttttttagaaagggtggaatttgagatgggtttagaaagggtagatttggggaggaaggaattttgttggtataagtagagtgaatagtatgggtaaaggtatggaagaaggattatataaaaggattatatggagatggaaggtttatgggttttgtggagggtttgagggagaggagattgaggaagaaggtgggttaggtttggggttggttatggttttaggatatagggttttaggattgaattaagttgggttgtgatgtggggtaaagtattttatgatgtatagggtggttttttgaaataggttagtgtagatatggttttgagggtaggtatgtgtgtgaatagagattataggggttttttgtatttatttatgagttttgtttttattagtttttagatatatatttgagtagttgaagtatatttgttttgaggtatgtagagggttttgtggatggttatgtttgtggttggataaggataagggtgaaggtttagagtagttgaagggaaatttgttttggggagaattttagggttagtgatggtggtatgatttttagggtatagtgtaaaatgaaaatataggattttttgtttaaaaattagtaagaattttaggatagtgattatagaatatgaaattaagtatgaggtttttttaagtaagggattttgtgtaattgtttaggtttgaaaataagtttttgtttgtttttttttttttttttggatttgtgtgggtttttattttttatgaatttatagtgttaaaataataataagtgaagttttgggtgagagtatagtttgaagattttagaattagtaagaatattagggaaaatatgattttaattaatgtttttattttgtttgtattttatgttgtagaatatttgaaggatttaagaaatttaaaaataagtttggtaattttaatatttagaaaaaattattattatttggtgtgtttttttttagtttatttttattttatgttttgtttttgtttttgtgggttttttttttttatgtgtgaggttatgtagatatgtttgagaattttaataagaatattaataggttggggtatggtggtttttgtttgtaattttaatattttgggaggttgaggtaggaggataatttgagtttaagaggtgaaggttgtagtgaattatgattgtgttattgtattttagtttgggtgatagagtaagatttggtttttaaaaaaaaaaattatatattaatagttattataggttgaatattttttatttaagatggttgggattagaagtatttaaatttaggatttttgattttgttagattttggaatagttggattatattttagtttaaaatttaaaattttttaatgagtattttttttgagtattatgttggttttaaaaaagttttggattttggagtattttagattttagatttttgaattagggataattaatttgtataggtgttaggatatgtttaagaagaatttagaatggtattgttttgtaggattttttgtgatgatagtaatgttttatgtttgtgttgtttaatatagtagttattaggggtatgtgaattttgagtgtttgaaatgtggttattgtaattgaggaattgaattttttattttattttattttaattatttttatttagatagtatttaagtatttttatttaaaagttaatggttattttgtagggttatgtagatttgttttttttttttttttattttttttttttttttttttttttttttttttttttttagatggagtttggttttgttgtttaggttggtgtgtagtggtgtaattgtatttattgtaagttttgttttttgggtttatgttatttttttgttttagttttttgagtagttgggattataggtgtttgttattatgtttggttaatttttgtatttttagtagagatggggttttattgtgttagttaggatggttttgattttttgattttgtgatttgtttgttttagttttttaaagtgatgggattgtaggtttgagttattgtgttttgttttttttttattttttaatttaaaatgtttgaaaagttttatatataataagtatgtattgttttagtaattaaaagaaagatagtaaaaattttaagtttttaaagtatttaatgttattggaaaaaaaaaatatttgagttttttaaaagtttatgatgggggaagattgattttgttagaataggatttatttttatttttttagttaatatatagaagaatgaatgtggggtttagaattagaagttgtgggtttgtttattggatttgttatttattggttatgtgtttatttaatttttgtgaattttaatttttttatttgtatgatggagatattgatgttagtgatttttttaggttgttgtgggggttgaattagataaggaaggtgagaataggaggaatggtttagtgatggtgtatatgattggagatgatttttgtagaggtggagttatttatttttgtgagagggtgttttttatagttttgattttttttgttattttttagaaagtaggaaatgagggtggtattttttaatgtgtgtttagatgttattagttgttgagtagaaataatggaattttgtggttaaataagattgggattggttgttttaaataatgtttaatggtgttttgttgtaggatttgttagagtttttgatatgttaatggttattttgttgggttatggagatttaaaatagtgtatgtttaattgtttattgagttattttttggggtgagatgatgtatttggaaggggttggtgtgtgtaaagtttatttttggaaaagttgttttagagagagttattggatttattatgggttataagtattgtgggggtggggaaattatttttttaaggatttaggaaattgtattgagattttaaaggaaaatttgttggattttaaatataaaagggaaaagtataatattgaaatgaattaatttgtaattgatagtttagaaaatataaattatgatttaatttttaaatagttttattagtagtaaatatttatatagtttttaattttatgttagttattgtttaagtgttttttatatttttgtttattttgtttatatatgtatttgagataggttttggttttgttttttaggttggagtgtagtggtataattttgtttattaaagtttttgttttttaggtttaagtgatatattttagtttatttaatttttataattttataagataaaagtttttatgaggtttattttatagatgagaaaattgaattttagagagattaaggtatttgtttaggttatttatttaggtagtttgtatttagagtttgtgtggtttgttaaagtatagtagttatgaattaatggatgtttttttaggttaaggagtatttttggtttttttttggttttatttttggtaagagttggtggtgtttttatgagtttggtttttatgttttttatttaaatttagagaggttggagtgatttaaggggtgaagggaagttaggtagaattagttttattatttttttattgggtgagttattgttttttttgggttttagtttttttgtttgagaaatgggttagtaattatttgtggaataagagaggggagatttataaaatttagtgtatggtttatgtagaaggtatttgaggtgtggtggttttttttttgtttagtgtatagttagagaaattgaggtatagagagagagggatagggttaaagttgagtttagagagtattttagggagttgggttagaattttatggtaatatatgtagggaaagagttttttttttttttttttagtaggtatttatgttgttttatttttttttttttttttttgagatggagtttttttttgttgttagattggagtgtagtggtatgattttggtttattgtaatttttaattttttggtttaagtaatttttttattttagttttttgagtagttgggattataggtatgtattattataattggttaatttttgtatttttagtagagatagggtttttttatgttatttaggagggttttaattttttgattttgtgatttatttattttagttttttaaggtgttaggattataggtgtgagttattatgtttggtttatgttgttttttttatggtagtatattaagtattttggtagggatttttgggttttttttttttaggttttttagtttttttggggtttttttatttattataggtttgtttgatttagggttatgtttaggtttattgtttgggtatggtgtagatatgttttggtatttttgttaggtgtttttttttgagtgaggggtaggtatataggtatggttttgtttatggttttttgtgtttgtttaggtattttagatattttaagtagagggaggtattttatatttttttattttaagaatagagatttattttatgtttagttatttgtgagattgttatgttttagggttatttggtttttttattttttgtgtttgaatttaatgtttagtagttgttatattgaaatgttggattatttttgttttgaattagtgtgttgtaaatgaagtttgatgggttagtgtagtatgtttggggatttggggtttgggtttagtttgttttttgttgtttttagggatgggtttttagtagtttattatttgtattgttgttttttattgaggtaggtatggggaggagaaaggggttggaatttgtatattaagttttggggtggtttttgagtatttgtgagggtttgtattttttgtataagtttttttaggtttaagtatgtgtgatattgaatagtaaataaaaaatattattgtgggttgagagtttatagaagaaaggaaaaatttttgtttttgtattttgaaaaggggttttgtattttttttttgtattgggttttataaagtaggtaattggttttgtttgaggattggagagatatgtaggatttttagaaatatagtgtaggtattgggggagtttagatgagttgttttgttgagtttttgtaagtgagaggagggagtaatggtttttggggttttttggggttttagggtttaggtaaaaagaggaggttgtagtgtgaggattttgggatatggaagttttgtttataggtattttgagtttagttatgttgattttttttggggtggttttatgttttgagttaaggtttatttttttgttaagtagggtgttaagggttaaggttaaatttttgttttagagaggtttggtttagagtggtaggttagaggtggtgggtgggtttttgatggtttttttggtttaggttgtgtggatgataggttgggtgaggtgggttgttggttttggtttttatatatattatggggaatgaaaagtttatagaggttattgtagagtgtaggaggttaggttatagtttagttagtgatgaaggttagtgggggttagtgataatttggattagaaattaagttgtggttaaggttgggatttagtttgtggttgtttggggagttaggttggggtttttttttgttttgtttatatttgttaagtttttggtgtgggtgttgggtagggtttgagttataggaggtgtttagtaaatgtttttggaggaatgaataaatgagtggtttgtttatggggggtggggtatggttggagtgtagttttggatgttggatgatttgtattttttatttagttagatttggatttaaattttggttttgttttttatattttgagggggatatttaattttttttttgttgtttttttagttatataatggggagaataatagtattttttttttaggttgttagagaatttattaagataaatttgaagtgtttagttttatagttgtttgtgggaaatgttttagtatgtgggaatgaatgtgattgtattaagaagatttgtagatttttatttttttaaagatatttgtagtgtttattgtggttataagattttaggttttaatattttttatgtgttttttgtattttttaagattttttattgtgtttatattatttgtattataggggtaagtagtaggaggtagggaggtgggtttgattaatgtgattaatttatagtattgtttaaatagataattataagaggaggttaggtagagttggttttttttaagtatttattggggttttagttttttagaggttttgatagtatttgagttttgtggtttttttatatgtatttttgttttggatatgttttttttttatatgtatatttgttttgtatgtatttttaatgtatttttgttatgtataaattttttttttttatgtatttttgttttgtatgtattttttatatgtattttgttttgtatatgattttttttgatatgtatttattttgtatgtattttttttttatatgtatttttgttttgtatatggtttttttttatatgtatttttgttttgtatgtattttttttttgtatgtgtttatttttaggttagattagtattatttgagggtttttggtaagatttgtgggtgtgttggggtttttgttataggttgttttagtttagtaattaaagtttgtttttgttattatgttaggttttttgttttgtgtgtttatttttattatgtgtatgtgaatatatattatttttatataagtatatatatattttataggttgtatttgttgtaatagatatagattttttaggaattttttttggggggattaagggttatttggtggtgtggtttgagggaggttgtagggggaggatgtttaatttttatttatgttgttttttttatttttggttaggaaattttttttttttttgggggtttttagatatttgttatgagtttttgtttattgggtggatgtttttggagggttgaggtttttaggaatttaggattgatgtgatagagttagggttttagtttagaaggaggttttttagttgggagaagttttagtgatgtttggagggttttattgtttgatagatggggaaattggtttgggagaaggtggggtttttttaggttattttaggaagaaaggtagaagtggaggaggtagttttatttggtggaagtatatagtagagagggtagaggaagttagttttggttaaatttttttgggttttgggttttttgtttggtagataggggttatttaggttttgttagttttggttgtgatttgtggggagttttagaaggatttagggaattttaggtgaagtttatatagttttttgggttgtggggaaaggaggatgtaaatagggagtgtttttaggggtttaggttaattttttgtaattatttttgtttttttttttttgtggggttaaaaaatagttttttatttgttggggtagggtgggttagtttttatttggggttgttaggttttttttagtttagttttggttaaaggtttgtttattttaattttttaaagattgggtttggttgtttgtggtgagttggtttatttggtagggttttttttttttttgatttagtattgagtatttgtatttattgtgtttagagttgttataggtttaggaggttgtttttgattttttgtttttttattttatagatggagagggtgagttgtttagggtatatatggagaaaaaataggtataggatttggttgtttagtttttaggttaaagtttgtttttgttttggggtagtgttgggattttgttttattgggtagtaggtagttaggtagtaggtagttggattattggggtagtgtttttgtatttttaggtgataaggtttagggtttatagttttttggagtatttttagtgtttttatttgtaagatgggagatagttatttttagttttagggttattgtgaggatatatagagatgtagagggtttggtatgtggtgagttttgtgggttaattattattaagtatgatgtttatataggtttgaggtttagaggatttttagattatagtgatttttgtggttattttggttggaattaagtatttgggttttagattataatgtggagaaatagttgagtaaatgggtatttttagtgttggatggaattagtgaggttttgggtgtagataaggtttttttttggaggaggtggaatattgtttttggttttttgttaagttgagaagtttaggttgttagtgggagtggggttggagagtagttgtggggaggatgtggggtggtgtttggagttttttagtgtttatattggttttagtaattttagttttagaatttgttttaaggaaggaattagggatgtagttaagatatttatgtagggtgttttttgatagaaatttggaaattttttaaatagtttattataagggaattatggtggtttatgagtagggggggaatgggttttttatattttggtttttattaggtttgtttagtagttatttgttttttgttattagggaggttttaagaaaataggagaatatatatatatatatgttgggggattttaaaagtaggtttaaaggattttatattgtatgtttttaatatttaaaaaaaaaaggaaggagagaagggagggagggtggggaagagaagaagataataaatttatatatatagtaagaagagtagaaggttgaatatttagtgggaattattgttttgggtggtaggattatggatggttttaatttttttttttataattttattattttttaatttttttttaatgaatgtgtattatttttataattagaaaaaaatgtgttttgttttaaggaatggggggtggtttaggattgtttttttttttttatagattttgaaattgaggtttagagtggaaataaatagtatttgtttatttatttagttatttatttatttatttatttatttatttatttatttatttttaaatgtttttgggaatttttttaaagttagatttagtttgaagttttatgttaaagagttgaaaggggtttatttttgtttttagggaggttatagttagggaatgtaaaggatataatagtaagtttttataatgtatttagataaggggttatggtggggaggggaaagagagggggttaagtttttttgggagttttagagatggttttataaagagagaaaagtaggatagggttttgatgtatgaggaggagtttagtagttagagaatgtggaagtatatattttgaaaaggaattgggggttgttagagagagaggatttatagtgtttaggggaatgggtagggagataatattagaatattttatgagttaagtttttaaaggtttggaattgtttggttttgttgtttaatggttatgtgattttgaataagttattaagttttttgggttttagtttttttatttggaaaatgggttaattattttattgggttattgtaagaattgagtgagttaataagtgtaaagtatttagtttgggtttggtatattgaagtggttatgaaattgtttgtttttattatttgttatgatttatattttattttgtaggtattttgggagttaaagagggtttttaagttagaagttaatgtgaatttatttgtttatttattttatttatttaatagatatttattgagattttaatatatatttaggaatggttttatgtgttggggatgaatttgttagataaaatataagatttttaaattattttaattttagataaatgataaataattgtaatatttggggtaattttatattaaaaaggagtttattatttatttgaaatttaatttaattgggtgttttatatttttatttgttaaatgtgataattttatttgtgaatgtaatattaagtaagtaaaaaatttttgtttttttgtagttgattttttgtgagagaaaagagataatttataagttaagttattgtgtattaggtattaataaatgtgttgaggaattgttaattaaggaagggagatatatttgttttttatgtttgttattataaattaatttatttttagtgttttaaaaaaaatatgtatttataattttatagttttagggattagaaattttttatgagttttttttggttaagattaaggttagggtagggttgtgttttttgttggaggttttggtggagaatttgtttttttgttttgtttagtttttaaaggttgtttgttttttatggtttatagtttttttttttatttttaaagtttatagttttgagttatgttttttttatgttgttattttttaggttttttaattagtttttatattttatttttttttgattgtttttttttgtttttttattttatgtgtgaggatttttgtgattatatggggtttatttggggaatttaggataattttttatttgaaagtttttattttttattatatttgtgaagttttttttgttatataaggtaatatagttataggtttggggattaggatgtggatatttttgtggttattattttgtttattataggagattagagaaggttttttggaggaggtagtagggatttgaatgaagtgggtagttgagttaggtagatagaatgggaagggttttttaggtaaagggtagtatagataaaggttttgtggtgggagtatgatgggtatatttgaaggtagggtggttggagtagggtgagggaggggtagagtggaagtagatgaggttagagaggtggagggtggtaggttatgtagattttattaagtttggttagaaggggagaattagtttttttttgttttttaatggtttttaagttttgtttttgaagtattattttgttttgttaagttgatatttattttaggagtatttatattttaataagaaattttgtaaggttttaagggttaagttgttaatgtttaggtttagtgatggatagtaaagagatattttatggtagagaggggtatagttttattttttataatattagggaattggtgattttttttaatattaaaggttaaattttttttagagtattgtaagatgagaaggaagaggttttttttgtaaatgagggatttaggttagatgtttaaaagaattttttgtgtgttagtagaaaattgttagttaaggttggtaatatttgggagtttaggttttggttgaggattttgtttttagggggtttgatatttagggattagtggaggttttatgatgatttgggggaagaatgagttttgattttggatttttttgggttttagtatgttatattttttttttagatttgtttttttgatataaggggattagttttagagatttttgggggttttttttgtattggttaattgttttagggtttttattttttaagataaaaatttggtagttgtgtgtttggtaggttatttaattttgttgagttttagtttttttaattgtaagtggggatgattatagaatttttttttaggatggagtaaggatgaagagttaagttgtgtgagtttttagaattgtgtttggtattgtgagtatattattagtgggagttattgtgatgaagattttaatatttttagggttttagagttttaagtttatgattttgtttttaggagttttatatttgttggttgtgggattttgagtttttagatatttttttttattttgttgttagtatgtttttaaagttttggttttttttatgtgttgggtggtatgtttgttttataattatatgaaaagttatttttttagggtgtttttatatttgggaaaattggtagtttgtttggtgttggttttgtttggtggttggaatattgggtaagattaatgatatttggtttggtttttggtgttgttattttgttttaattagggttgggtgttttttgttttggatttttgtttagttttgagttgttgtttttttttagattttatttagttgtttatatttttagtttgtgattttttaggagtggtgtttatgggttggttttatagtggttgtagtttgtttggattggggtggttgaataatatgttaggtaatgggtaggttttgaggagtattaggttgggaggtgggagtttgggttaggttttggtattagggtattgttgatgttgattttttttattttagttttagttttttgtattgtaggttaggttatttaggtttattttatttggtttttagggttgttgtgggagaagtaatagagagaaagggtagtaagagttttaggaattggggatattagtagtgtagaggagtggggagaaggtaggtgggtaaagttagttttattgtgtagtgggtttttttattagtttttttttttttttttgggttttttttaattttttggttttagtttgtatgttatttgttttgatagattttttttgattattttgtttaaagtattgttaagagtttttttttttttatttatttagttattttttttgattttatttttatttgtttttttgagtgttttaagatattattaaatattggtgtgtttatttatttgtttttttgtttgttttttgtttgttttgttggaattaaagtttttaaggagttttatggttttttggtttattgtttgtatttttagtatttaaaatagttttaggtgtttaataagtgtgtgttgattgttttaatttagtgttaatttttttttttttgtttgttttttattttttttttttttttttattttattttttttttttatttaagtttagagttgttaagggtaggattgggaatttttttttttgaggatatggatgggggtaggggtaagtttaggtttttgtgagttaaaagggtttttagattatttagttattttggatttgattaaggtttagaggtgaggtagtgagagggttttttattttaggtttgaggatatttagtgggtttttggaagtttatttaggtgataaatgttatatttttgttagtggaaatttatgttaatagtaaatgatagagtgtttagtgtttgagtttgttatttggatttgttaggtagggagtttaaagtttgttttagttttgtttggttgtatttatagttttagtatttttttagtagttatgattttgtaaggaggtggggatttaggttattatatagggttagtattattttgggagtagattttttaggtagtattttttaattttagttaatttttttgttggtttttggttttttgggatttgttgtggattttggagttattgttttgttttttgtttttatgaagtttgagttttttatatagttaggttaggaaatataatttgggattaggttgttgaggtttaaggtttagttttgatatttatttagggtgtgaatttgaatatgtttttgattttgttatgtttttgttgttttattgttataatggggatgatgataaatgtatttaatataaaagtggttttggggatttaatagtatgtgtgagtgtatataatgttagttattataattaaggggtttggttttttgggtgaggttgttgtataattttggtattgatagagttggtttaaattttagttttgtttttttttatgtaggtgtaagggatttttttgtttgtaaagtgggtttattgatatatatttgaagggttattggttggttatgaggagtgtttggggagtgtgtttagtaggggttgttatttagaagtgtttatttaggtgggggttgttatgatgaggatagttgtaagggtttgtagagatttaattgagagtgtgatggtatataggattatttggatgaaatagtgtagttttgttgtattatgaataattgtatgatattatgtatatttgagtatattgtttatttttttagaggtttggggtaggggaattttttttatattttattttttgtttttttttaaaatatttttaaatatgtaaaatatatgtatagaagaatgtataaaatataagtattgtttaaagaagaagaataaagtagatatttatttatttattatttggttttaaaaaataaagtattaatgggattttagggtttttattagtgttttttttttgattgtatttttttttttatttattataggtggtaagtggtggggattatttttttgatttttttttttttttttggtagatatagagttttattttgttgtttaggttagttttgaattttaggttttaagtagatttttttattttatttttttaagtagttgagattatagatataagttattatgtttagttatgatttttgtattaattatttttttgtttgtttgtttgttttttatttttaatgttattttttatttataagagtagaaattttgggatgatttgaaagattaataataggggatgtgatttgttggagtttttggaaataatttgttttttttattttatagatgaggaaattgaggtttggagagggttaaggttatgtagatggtaaggtgggaatttagagttggtatgttttgaattatggatgattggtttagaaatggagttttgtagttgtttttttatttgtttaatatgtgtttgttatgagttgagtgtttgagatattagtatttggtttggtttttgttttatttaatatttgaattttttgtataatattttggttttaatttgatttttatttttgaggggatgtgtttttattttaagttagtttttaatatttttatttttggtatggagtttttagtatttatatggtttttgttatttgggagttttttatagatttgttagaggagtttttattttttaagtttgtttttttttagggtaaagtttttagttgttttaatagtttattatgtgatatggttttagtgtttttttttatgttgaggtttttgggggtgttatatggttttaatagagggggtttaggatgaagtttagagaggttatgtgttggtttagggtattttaatttaaatttaaatttaggtttttgggtttttaggttagtgttttgtttttttatttatgttgttgtggggtattttagttgtaatttttttatttttttttttttattgtttttttttggattaggaagataggttttttttgtttttattgaataatgagggagtgggttaaatttagatgttggggaatggtttggaagttttaggggggtaaattatttagaaagtttatgtttttgaattgaggagaagtagaaatttttagagttagggtttgattttttttagagttgttttgtagaataaatttaaagttttgagttttgattttatgtttgtttttgtgtgtaaagatttgtttatataatggtttgttgtttatatagttgtgatgtgggtttttgtttatgtgtgtgtttatattatttatataatggggtttatttgtgtatttatttgtgtatttatattaataggtttatgtatgatgatgtagatagaggtattttttaggagtatttttgtatatatttgtatttaattgtttgtatttgtggttgtattgtaataatgttgttttttatgagggtttgtttatgtgggtgtgagttgttagtgaatgtgtgagagattgtgtttatgagtgtgggtgttgtgtgtgagtgtatatatgtagggtatagatgtgtgtgtgtgtgtgtgtgtattttgtgtgtttagggtttagtggagattttttttattttagttttttattttatgtgtttttttagttttggagtttggttttttttttttattttttagttaaattataatttttggaaaaggggtttttattatggaaatattgatatagtttaaatgtgattggggagaaaagggttgttgttattttttggtttatttttgtttaaagagagtgttttagtttattttgtgttgttgtaataaaatatttgagatgggataatttataaatagagaaatagaaatttattatatatggttttggagattgggaagtttaagattaaggttttggtaggttttgtatttggtgaggttttggattttttgtttttaaggtagtgttttttggttgtgttttttggaggatatagaatattgtgttttgaagttagaagggtaaagagggtttaatttatttatgagggtagagtttttattatttaattattttttgaaaggttttttattgttttttaatattattataatgggggtgaagttttaatgtatgatttttgggagatatttaagttatagaagaggaattttattgtttgttaaggatttttagttgtgatttttaggtttggatattgagggtgtttgatagattatttgggttaaaggtggtgggataagggtaagttgagttgatgttgaggttagattttttgaaagtttgtgtagaggtaattgggttagttgataggagttttagagttaagtttatttgttaataagtattttttgtgatggtgggtaaatttttgattttttttgggttttggtttttttagttattagatgtggaaatgaatagatttgttgtagattaatatggaattttagaatgttgaagatagagaggttttttggggtttaggtgtggtttaatgtatttatttttttgaaggggagtttgagggttagagagggaagggatttgtttaaggttatttagtaaggaataaggaaatggttgttttggatttagtagttggttttatgagttttaggtttaggtttggttataggatatggtaatttatgggttttgtttagttttaatttttattaagaatttggatttttttgagtttattaaggtgttagatttaattgttttttaattagtgagggtggtagaggaaaattgtagtgtgaaagagtggaagaagatataaggaaggatttttagatgtttagaatggagagttgtgggggagggggatagggtagggttttagttatattttagattagatttaaggtagtgatttgtatggaaagagttaataaatttataagtggtataaataattataaaattgagattttatttttagttttatggatttaggtttaggtttattgttgtttaggtttttggtttgatattgatttgagaatttttatttttttggttttagttatgttttttgttatttgggaatagagtagtttaattgtgtgtatttttatttttttgggtatggtgaagatgaaataatgtagaatgtagagttgttaagagtatttattttggagttagggagatttgagtttaagtttaggtttttttgttatatggaagtttttttgagttttaattttttatatttgtttaatttataaagttattttgaagtttattttaggtgatataagtaaattggttagtaggtatttaagaaattttattttttgggattgggtatatggtaggggttaggagagatgtgataattggtgatgaggggtggatttgtggttaggattggttatataatttggggggtttagtataaaatgaaaatgtaggatttttgttgagtaagtatttagaagtttaaggtagtggtggtagggtattaaaataagtttaggatttttttgagattagggttttgtgtgattgtatgggttataggttagaaagttggttttgtttttgggatatttagggtggtttaaatttagtttaggtggagaagttgaggttttttttattatattgggggttattttttttttttaggattgtagttgggattatgattgttggttttgttattgttagtggatattagaggtggtataaaagattgattgttgtttatttttgtatgtttatttgtattttatgttatgtgtatagtatatagttgatttatttttgtaaagggttgtattttttttttttttttaagggtgatgttggaaagttatgtggtttttattgttggtaggaatgtttgaggtgtttttttattattatatgaaatagagttgtaatttttatttgtgtaaggttaaagtttttagttttttttgagttattggtttttgagattaattaaggttttataaggattgatagttattaggatttttttggggaggtggaaaatttttaatgggtttggttgggtttagaagttgttgggtgggtagtggggagaggagggtttgtgagagaggaaggtgtggagttagtgggaggtagttggagaggtagggggtgtagattttgtttttggtattggttgtgattttgagtgagattttttttttttaggttttagttttgttatttgagaaatggggatttggatttgatattttagagtttttttgagtttgatattgtaaaattttgaattttgtttatagtttttttgttaggattttaattttattttatgattgtaattttgagtatttggttttagtttataagagtagagtgtagtgggtagtaatatgggttttggggttaggttgttttgttggaattttatttttgtggttttttagtggtgttaatttggataagttatttgagttttttaagttttagtttttttttttgtaaaatgggagtgataattgttgttattttttaagaatattgtgaagtaaaaatgtgtgtaaagtaatagttatttagaagagttttttttttttttgtttgttagagttgaattttattttgggggaagggtatatgttttttagaagtttttttggttttaagttgtttaggttttttttattattttatggtttttagtagaagagtttgtgtttgatggttttgttggtaggtagttttgtatgtatttgttgttttggatggagagttttgtgttgagagtagtggttagagtgtagatagtttttttttgattgaggagtggggtgttggaagggtttttgagaatttgtttgaattttttagattttgaggtttatagaggaaaagttttttatttttggagtttgggtttttttatttgtgaaatggaaagaataaaatttttgttttttagaggtatttgagggtgagtgataattggtggaaaatttttagtatgtggtaggtgtttaaaaaattagggtaattattagttatagattaatgattaaagttatagattagataattgttttttagaagtatttttttgatttatagatgataagagtgagtagtagggagggtggtaggaaggttttattaagtgatgggatttgaaattagaaattttttttttggtaattgatggagatggtttttttgttttgtgtttttgtaaaagaagttttttttttttgtttttgttttttttttttttttttatttttaaagtagagtattttttgattatttatttgtagaatagggtggggatgggtgtggaaggatttgaggttatgtggatgtaagggagttggtgttttgtgggaggtggagaggaggtgggtggggaggaggggttttgggttataattaaattttggggttttatggaatttgtatggtatgtagaggggttttgaaagtgtatttttgtatttagatgtaaatattgaggtttagagggaaatatgtttgattagtattttttttgggtgagaggtattgaatgtggtattagggtgttagtgtatgaggtttaggattgggttgtagttttttgtaaggtaaaggttttgtttaattgtgttttgttttgaggtgtttgtttttggttttgttggagtttattttagattttgattatgtttttttttttttttgggttttagtgtttttatttgtaaattggggattattgttagttttgtttttttgtagattggttttgaggttaaaggagagtaggtggtgggtgtattttgattattataggatttttttgaatgattttggtaagttttttttgattttttgtagatttgaagagtttattgatttttaagtttagggttgtttagtaggatttattaaatttagttttttttttttattataatagtttttttttttgtatttagatgttagttttttttattatttagttattaggaggagagtgttgatatgtttggttaggtgatgtgtttatgttttatattttgaattagagtagatttttaatttgggtttggttttttttagtttggttgattttggataatgtttttttttgtttatatgggtataatatttattatatatgatgttgtggggattgaatattatgagtaatgtttatgtgtggtgtttggtataaggtaaagttttagtatttttagttgttattgttttttttattttatttttggggattaaggtttaggggagtgtggatattaggtaaaagttttagattgtataggtagtatttgggttttaatatttttattattttgtttttttttgtttttttttttttttttttaagtttggaattttttaaaaaggaagaaagatttttgtaatttgagaagtatatttgtgtttttatatattttgaatttttttagagaggttgtttaggatagatgattttagagttggattttttggagttggatttttggtttataggagataattttttaatttagatatattgttattttttattaatattttttgtttatatatttagagattattatttgaaattaggatgtagatgagttttagtttatttagtagtattttttttttgtttttttaaataattgattattaattataatgatgtttttttttttttagagggaatttttaattttttttttgtgaaatggagtggttagaatgatttttattgatagaagaggaaattgaggtttagtgaggggtatgaatgttttttttgagttttagggtattgggtaggagataggttttattatgggtttttttggataggggatttagggttaggttgggagaaatttttagttttagaagagagttttttgttttttttgttggattaggtttttgtgtgatttgggatatggggaatagaggttttttgggaaggaaatggggtttttggtagtgtttgttgaggtttagttgttatttaggaaagggtttgtttataggagggtggttggttgggggtgaaagtgaggttttgagaggaatggttagataggtaattattgagatttagttttggttgttttgtgatggttgttggaaattttgttatgagttgattttatgtggaggtaggttatagttagtttttattttttttaggtagtttgtgggtgaattgagggattaggatagtatggattggtttggagttttagtaagttttgaatatgagaattggatattttatagatggaagtgtgaggtttagagagaggaggggtgggttaaaggtttttagtaaggattgagaggttttatttttttatgatagtgatggtttttggaggttggagtattttttatgtgttaggtttgtgttaagtattttatatataattttatgaagggttattatgagtgttttattttataaatgaaagaaatgaggtttagagaggtttaggtaattttttttagagtgttgtgggtgagggaaaaagatatgtttaggtagagggattgtggattttagttttttttatagtttatggattttttaggtggttttttagggtatatttgttttttgtttggtatatttggggatttttgtttaggtgttatagagtttatatgaattatatttgttttgggaaggtggtatttttattgttaagaatgtatttagagagtatttttaaatgttagagggagatgaattttttttttggggtaaaggagttggttttatttgtttggggatgggttttgggtttatttagttttaagttaaggtagggtaggggagtgttttgattttttgttttttagttttgttgtggataatttagggtgtttttaggtgggggttattggggagaaattggtttgtttgtttattgatttgatggaagagggagaaaagatgatggtttatgttaattggggaagggtgagggtgtttgtatgttttaggtgggggagttggagtttttttttttattaaatagatgataatttttgttggtttgggatggggaggaagtaggtggaaattgggaataagttagtttgttttgtgggttttttttgggtgtttgaaaatgtgaagatagaaggtgtttattttattagaggtgaggaaggtggttttggtttgatataaagttattggtttgtttgagatttggttgtatggatggtaaggaaagggtagttttttgggggtggttgttgtgtttgtatttggggttgtagttggtgtgtatttgtagtttggttgggtttgtatttttgtggttggtagggtgtgggtgttaattagtggtggtttttgttattgtgtttgttaggtggttttgtgattttggtttggggatttaagggtttgtatttgttttttttttttttgttgttttggttttttggatttggtgtttatggggagttagtgttttatggagagttggagttgtgttgggttttgtgttaggtgttagggtttataagagttttttattttttggaaatttgtttgtgaatttattgtaagtggagagggagaaattaggtggaggaataagtaaagggtatggtgtaaattgaaattatttgataaatggaatttattattatttgaaatagtgggttatggttttgtaatttgtttgagggtagtatgtgttgtttgtttttggttagggttttatttggttatgatgtgttgtgtttttttggagatgtttttggaggtgggagtgtttaggttggattatttgtttttttttagttttgttgtttgtgttagtgtgtttgagggtgtgtgggtttgggtttgtaattgataattgttaggtgtaggtttttttaaaaggtttagtaagggatttttgttgtttttttttttgatatggtttgagggtgtgttgtgaggttttgaggtgggtaggggttagtttttttggtggttggggtgagtttagagttttttgtttttggagtgtatgtggggtttgattttgtttggtaatgatgaaatggtgtgtgttgagtaggggttagatttatgatgagattttgtggttattgttggattttaagtttttttgtttttgaggtttggaatttattgttttgtatttgttgagagttggaggtaatgaaaatttagttttgtttttaaagtggtggggaggtttagtatgtgtttgttttttagagtttagggaggtgtttggggtgataatttggaatgattgtggtttgattttttttgttgtttttttaattgtagttggtttttaggtttgtttgatagatttaggaggtgggagaggaaggggtgatttgtagtgaagtttaggagaggttgggttatgtggttgggagtgggagtggggatttggagttgggtgggtaggtagtgttttggtgaagttgtttgtggtttttgtggtgtagttggagtgtatgggtttaagaagaagtggggttggatttgtagaggttattttttatttgtatggagaaagaaaatttttttttttgaaagtgagggtttttagttttgtagttattgttgttttttttttgttattgatgtgtgtattgttttatgatgtaggattgtggttatatgtgtaaaggaaaaaaagaaaaatgtattttgtaggttttgttgtgttttttaaagagttataggttgttataatgaagaatgatgttgtgaggtttgtaagattttgaaatttgttttgaggggagagtagagaggaaaggggttgttggttttaggttatttagggtttttaggagatttttttttgtttgtttttggtttggtataggggttattgaggttgggattaaagttgtgtagggttgggagtagtaaaggttgttggttgggtgtggatgatgtgtaaaattttgtgtggggtggaggtttttgggttagaataatgtgtgggatgagggaggtgagtaatttttttggggtggtttttagtgtggtgttattggttttgagattttgtggtttttagtttggggttgtagaagttataggtttgaagtagtaagagttggggaagtttggttgtggttagtggggaggaggagtgaaggggttgtgttttagtgttagggagttatgatttgagagagggtggtaagggtgttttttgtgggatttggatgttttaagtaaatttttagtatttgttttgggtttttagagtttttgggggttttgggttgtggtattggggttttttttgtggggtggtgttttttgtttttttttgttgggtggtttttggtaggttttgtttttttttgtgaatgttattgaggtgtttgtgatgggggttttgttgattggttgtgtgatgtgttgttttgttagttttgttttgtgggttttgggggtattaattttgtgtgggtggttgtggttttgttatttgattttggaggatttgttttggggttgtggttgtggagttggggtggttgtgggtgagttttggggtgggaggtggtggtagtggtatagttttgtgtgggttttgttgtggtttaggtagttgggatagttatgaggggtggttgtatgtggggttgtgtgttgaggatgtgggattagttgggtaggttgtgggtggttgttgggttagtgaggttttgtagtgggtgggttttggtgagtagtggttgggtgttgttttttgtgttttgaggtttgggttttgttgtttttgtttttttgttttttgtggtagtggtggttgaggaggtgtttgtgttggttgtttttgggggaagttgtgttgtttttgtttgtttggtgttttgatggttgttgttatgtgtatttttgtagatttaagtattagttgttgttttatatttttttttttggtttttttttgtggtggtggtggtggtaagatgggtgagaatagtggtgtgttgagtgtgtaggtggttgtggggtttggagggtgtgtttggtttgaggtgtgtttgatggtggatgtgttggtggattatgtaggtgagtttgtgtgtattgatagttttaattttttttgttttgtgttgtttttgtattggtgttgtaataagatgttgtttgttgtttttaaggtgagtgtgggatttggggtgggagggtgttggttttggggttttgggtgtttgagttgtgggagttagagttttgggagtagtggggatgggaggtgtttgagatgttgtggtgatatttgggtatttggtttagtttggttgtgtgtttggttttgggattttggtgttttgttttggatgtgttttgtaggaatgatttttaatggggttgttttgttttatttgggttttggggtgttttgtgtagagatgttggtgtggaaatgggtggatggggttttgtgtttttttaatttggattgtttagatatagttttgtgggtaatggagaagaggattttgggataggggtaaggatattgtgggtggggtgtgaatggtgaaagggtttattttttgtttttagtatttttttttttgtgttgttttgtaaaagttttttgtttatatttttgggtttttgaaattttattggatggtgttaggttgggattggggtattgttttttagatgtttgtttggggatattatgtgttttgaatggtgagttgagattgggggatttttaattttggtagtttttagttatttagaggatttttttttttatgttagggagtaggtgattgttttatttttatttttttaagggggtagtgagatgaaatgaaaatgttttggtttttttttaaattttttatagttgttgtgagaaaagggtagggtaggaagggttggtggttgggggtggtgttgtttgaggtggttggaagttgaggttgtttttgtttttattaagatgattttaaatgggaaaaaaaggaagagtggttttttgaggttttttgggtgatattttaaaatattagtgggggaaattttgttgggaggggtgggaggtttgtgtgattttaattgttagattggaggttttattgttatttggagtttaaaaggagtttttgaaattaaaagaagataggatgttgataggaaatttggtttttttaattagattttaaatattttttttttgaaatttttattatatggatttttagtttttgtatgtggtggttatgtttaaatagttgtgattttgtttaaagtttgatttttttttaaaaggtatttgtttttttgtgtttttgggggtgggggatttgggggagatggtgtttagggggatattgttatttttattttgtaatttttggtaggtgtatttttttattattaaaagttttatttttattttaaaggggttttttggtggttttttttaaaatattagtgagttttgtattttgtattttttttgtataatgaatttaggttttgtagaggttaataaattgggtttggtttatattttagggttaaattttatgttttaaatagtttttgtataaattgagtgggggtagtagttttgttgttattattgttgttatttttttttatttggagattttgttgttaggagtatgttgattttttttttgttgtagttgaagataataggggaattgtattttatattatagtgattgagttgatttatagttttggtttagattttattgaaaggatgattttttgggatatagtttatgtaagtagttgatttaggattttggtgtggaagtttgagattttatttttttgtttttgtgatatttgggggaaggtttttattgtttttaagttttttttttattttgtattggagaaatatttagtgtgtttgggatttgggggagttgtttagtttagtttttttttttttttttttggttattttttttttttttaagttgtttttttgtatttttttgttttgtgtttttaggtggtggtattgggggatgtgttggatggtatggtggtgattgtgatggtaggtaatgatgagaattattttgttgagttgtgtaatgttttggttgttatgaagaattaggtggttaggtttaatgatttttgttttgtgggttgtagtgggtgaggtaagtggaagggaggttttgttattttagtattggtaatggtaggggtagtagggaaggaggttgaaagaggggttttagaattttgaaaaataggtttttagatgtagttttgtttaaaaatagtaatttgtaattttgtaggatattatagattgttttgaggaggtgaggaaagttatggttttttgttagaaaaagataatttttttttagtttttagggtttattaatttttgaaattgtttatgttatttttttttttttggttaagtatatttggttttataaaaaatgttggtaggagatggtggattaataagtttaaaaagggagtttataggttttttagtaaggtggttgtaggataagtttttgatttgtggggtttaagtattttagttattttttttatagggggtagaatattttttatattttgaggttgtttttttagttgtggttttttagatttagttttttagtgtttttgagttttaggtggtttagaatggaagttaatgtagttgaatgttggaaagtatagtttgaaggttgttattttttgttttagagttaaggtgggtgtgttattttgtttgtttgattgattttgagtagtagaaggaaggtgggatgggggtggggggttgttgaatgggaggtttttgggatttgaaatttattattatttaatttttggatgggaaagttttggaaattttgtttttgtggaatggaggtttgagggtttattggttttttaagattagtttgtttatgagaagtggttgaagtgggagttgttttttttaagtattaggtttgtttttagttttgttaagaagtaagttgggttttttttgttttttaattttatagtaggttgaagtggttgaagtagaattgtgttttttattattaataaataggatttttttaaggttttagttttttttgagttgttagttttgttttgaaataggtatttgggtattatttttttttttttagttgtttgatgtatatatataaatgttagttatattttgattttttagtattaattaaaattaggatattatttgtatgtaataattgtttatttgttattttttatgaaattgaaatagtttatatttttttaaatattttttgtttttgttggtttttttttttatatatagattttttttaaatggtgtttttaattggttgtaggttgatggatggaaaatgtttgtttttatgaattaagtttttattgttgtttttaattagtttttaagttttttttgttatttttaattttttaaattttttgtgatttaattttaattttgagaggatagttattggtttttggttggtggtagataaggttgatgagttttgttgattgtggggtagtggttaggtttgttagtttaggtatgtgttaggagtattatagttgttgtttgttgtgaggtgggtagaaggtgttgttgatttgggagtttagtaaggtattaggaatttgattttttttttttatttttttttttgggaagtgagagaaagagaagagatgatgattttttgagttattgagattttgtttggttattttgtatattgagaatgatttttttaggggtttttatgtttatagattttgagtttttttttttaggtttgtagggagggaaatgggtttttaaggtgttggttgggagtttgtttttgtagtaggaatggttgaggttgggattgtggttttgggagatgtaagaggttgagtttataaattatttttttatttatttttttttagaggtttataattagttttagtggttttgggaggtaggaagtgatttgaggaggagttttgatgtttgaggaattgtggttaaggtgtttagtttttagaggtttgaggtttttgagagtttgtattttagtattagttattttgtgtttgagttttagttttgttaatgatttgttggatgatattgggtaaatgatttaattattttgtgttttagtttttttatttgtgagatggggatgataatggtatttattttatgagattttgggaaggttagggaaattgatataagtgtattagttggtgtatattgagagttggatatatgttagagattttgttattttaaatgtttgggattggaggaggattttgaggtttttttgagtggtgatagttattgattttttgattattgtgtggtttgggtgggggtgggggaaatttagaaggtgtgaattgttgagtgggagaggtggaggtggttggtagggaggaaggagggtgttgggtttgttggtatgtagatatatatttgtagtgtttattttgttgattgggaaatttttatttgagagaatagttagtggttgatagtgataatttgggttattttaggagatgggatattttgggagttaagattgggggttgggatttagaatttttgtttgggttttttgatttttgttagaattaagaagtttgatggaaatttttgtttgttgttttaatttttagttttatattttgtttgaattttaggaagatggttttttatgaaagatatgtatttagtaatattatagagtttttaataatagggttgaaggtgtgaattaagaaaaggaagggaggaaaattaggttattgttgttttttgtagtgattagggttgaggtttttgttttgttagatatgaggagttttttttataatatatattttatattaagttttattattttatgttgaaatgtataaataatgaaatttatttatttatatgtagttgtaaattatgttattttatagttatgatggagaaaaaaagggaaagtaatttataataaaatattgatttgaatatgtaaatgttggggttataggattttatgaggtggatgaatgttttttatgtagaagtttatagtagagggaataggtagggtggtagggtttaatttgaatttggttttgttgttaatattatgattttttgaagttgttaatatttgttggtaaagtgttgaataaaattaaaaaaaaaaaaagaattgtttttttttttggaaaatttagtagatattaaaagtataaaaaaaatttttgttttatgtaaaattgagttaggtttatgatttagataattttttttttttttatttttttttgggataaggttttgttttgttgtttaggttagggtgtagtggtgtgattattgtagttttaattttttggttttaagtagtttttttattttaatagttgggattataggtatgtgttattatgtttagttgattttttaaaattatttgttgtagagatgggggtgttgtttattgtgttgtttaggttggttttgaatttttggatttaagtgatttttttgttttagttttttaaagtgttgggattataggtatgagttattgtgattagttagagaatttttataagtaagttttttttttttaggaagaattgaatttttattattttgggtagtgttgggtgttggtattttttattatatatatgtattttatttttaatgttggtagtgttattttaatattatgttgattatatgttattataaattttaaaaatgtttttttagtaggtggttattggtttaagtgaaaatgaaaagtatatgagtttttgagttgtgattaattggttaaaaagtaattgtgtgttgatagagatttggggtgtagtgtgttggtgtaggttgaggggaattgttggttgggggagagatgaatggttttttggttgaagttgagaaaattttgaggttttttgagattgagatatgttttttttttttatttatgtagtttttgtgggtggggtggggattttatatatataggaatttaggtagagaatgtttaaggatttgtttgaggttttgttgttattttggttggttgatgatgggttttggaggagtttttggagttttaaaggaaatttattttttagattaagattttttttttgtaattagggttagtttttagagagtttgggtttatattttttgggtttttgatggattgtaggtttgtttgggatttttgtatagagttatatttagaggttgagagagagggatggatgggtttgttattgttaggtagagagagagttgggtagggttggggtagttgaggggtatttagggagatagtttttttttatttttgttttttaggttttttgttttttgaggtttaggatttttgttttttttttttatttttttttttaggttttatattttttttttttgtatttgggaggggtggtgataggtgtggaagttggtggaagtggttgaggagtgttggtgattttaggggtggtatgtggtttgttatttggtatgggtgggggttttttattttttaggagtgggatgttagtatttgtgtgtaaaatgggagttattatttttgtttttaatttatttaataaatgttgttgagtatttattttgtgttggatgttgttttaggggttggagatattgtatgaataagataaaaatttgggtttttggggaggttataatttagtagaaggagataaaatgagtagatggattattaaaagtatatgtattgtgagaaaattttagtaggtgtagggaatagagaaagggagtggtagggtttgtgatattttaggttgagttgtttagtgttttttttttttttttttttttttttgttttgtgggtttttttgatagttggtgaagtttgtatattttttttagaataatgatatttttaaggtataaaattaaatataaagtattataatagaaattatttttattaaaatatagtaaaatattttaaaaattgtggtaaatgtgttgttttatttaatgtattaaataagatttagtattgggtttaatgataattatggttttgaagttgtgatgagtataaaagatatttagagtaatttgtagtaattgtaatgtgatatgtaagtatttgtgatgtttgttggtgataaggttataggtatggttgataatatttttgtggtttgttgtttatgtttgtatttgagagtgatgttaaattttagttagaggttagggataatataattgtaatttttttttattttagtttttaggtttatttaattttatggagttaagttaaaaatgttttttaggtgtagtggtttatgattgtaattttaatattttgggaggttaaggtaggaggattatttgagtttaggagtttaagattagtttgggtatatagtaaaagtttgaaaaaaaaaaaaaagaaagaaaggaaagaaagaaaagaaaggaaaggaaggaaggaagggagggaaggaaaagaaggaagggaaaaaaagaaatagttgggtatggtggtgtttatttgttgttttagttatttaggaggttgagataggaggattatttgagtttgggaggtttaggttgtagtgagttatgattatgttattgtattttaatttgggtgatagagtaagattttgttttaaaaaaattaattaaaattaaaaatgtttattttagataaagtgattagggaaggtttgattgagaaggtgggtgatttgaaggagggttttagtaagtttttaaatgttgttgtgggtttggggttttgtggtagggtattgggatttattagttttttgtgtttttagtttggtttttagggttttgggttgtttgtttaaattttttgttataattaagaaggtgttggataatgttggtagggttagaggtttagggattttaggagagtgttgggttggttggaggagaaagaggtttagtagagaaatgattttagagtgaggaaaggtagtaggaggggttgggtagggagtttgaggtatttgtttggtatttttttagattatttgtatttttgtttttagaaattatataaagtggtttttgtgatttgagagtgggagattaggtttgttttgatttggggttttgggggtaagtgtagttagaatttttatttttgttttagttgattggtttaggaaaaggtttttagagaagttttttattttttagttggagtgatatttagtgggttttgagttttaaattttttttggtgttttagagggttttgggttttgtggtatggtttttggtagtttggttggtttaattttgttttggatttttttgtttttggggttagaatttttatttgattagttgattaataagtatttggttatgtaaagagaattgtgagatattggtttttattttgagttttattttttatttgtaatgtggggttgttgaaatttatttgtttattttggaggtgtgttagggggatattagagggatgtgtttgggtagtttttttttttgattattttgtgttagttttggggtataggtgagagtgtgagattattggtttttatttatagggagtttttaggtttgtatgtgggatttagaggtagggatagggggataaagtttggtttgggggatttgtaaattttttttgtttttggttattaattttataaagtatgaggttgtggattgtaatagagaatagggtgagaggaggatttttatttagatttttaaatttttagatatattagagaatttattgtagaaagtagagagaagattgttgaaagtaaatttttataaattgttttttatatggagaaatttgtttgaatataaaatgatagaagaatgagaaatagaagtgaaaatgaaaaattatttagtgtgtgaaggtaaaatgtgtaggtttgtgtttggggaaattgatggttataaatatagtatggaaagtattaataagtttaatatatagtaatttttaaaaggtattaaaatttttataggaaagtaaaagaatatgaagtagtaatttgtgttggattatgatggataataattatataaaaagttttatttttattagtaatagaaaaaaaggtaaataaaattaagagtgtgtaaaagattttttattttgatagatatatttttggggtgtgatgtagttttatatgtgagggtgatgattaaatttttttggagagttattttattttaagagggatttgtgtttgtaatatgttttaattttttgttgttgtgaaattatttattgttttttggaattttttttaaggaaataagtagagatgtagataaagatttttataaatagaaggttatttttattttattttaaatggtaaaaaaaaaaaaaagtagtattttaaaagttttttttttttttaggaattttgaatggagattttggagttaaatgtttatttaaaaatagaatattttggaaataatagttgtgtttatagaagaaatgtttgtagtttttaaattagtttttttttagttttagttgtatatattaataagaaattagtaatgatgtaaatatttgagagtaaggaggtagataaataaaagatgaggaggtttttttgagttgaaatattttgtagttattaaaaatgaagtttatggagttttaatgatgtgggaaagtgtttttgatgtgaggttaaatgaaaaaaaaaatagtatgaaaatttgtattttagtattattgtgattgtgtaaatatataaatttatataaaaagagttgaaagggaaaatattaaatggtaatggtgtttatttttagttagtggaattgtggggggggggtgtttttttttttttatttatattttgtatgtttttgaatttttttataaagattattaattatttttagaaaatagaatatatttattttgttttttattataaaattgtgtgggtttttgaatagaagagatagtagaaaggttaagaagaggggaatatgagttagggtggttatggtatggggtggggggttgataaagttggtgttagatttttaggggttttgaatgttaagtttaagagtttgaattttatttagagttttattttttgtttatgtttaaagaggatagagtgtttttttttgatagttaggggtttttaggggtagatataggtgggagagtagggtattgtggaagttttaggtgttaattatttgtttttattttttattttttttagggaagagttttattttgattattattgtgtttattaattttatttaagtggtgatttattattgagttattaaggtgattgtggatggattttgggagtttagatgtaagtgttattgagttttttgagtttttgtgtgggggaggagggtttagtgtgggaaggatagtagttaggttagatagatggagttttttttggggggttgtagtttttggttttgtgtttttatatattgtgtgtttgttggtaaatttttaaattttttgggtttagtttgagattgtgggaggttagtgaggaggttgggagtggagatgattgtttatggagattattgagggagttaaggaaaggaaaaggatggagaaagtttttagatatggtatttgttgggtgtttgtgtgtttttgggtggaggttgagttaggtttgttttattttgtttttagtttttttgtgggtggttgagggatgtatggagggtaggagtgattaaaagttaggggttggtttggttgtgaggttaggttttttttttggaaattgagtttttgaattttagtatgtgatttgtttaggttatttagagtttgggtatttagattttatgagtagggagttttggtttattaaagtgagtttgtgtttaattttttttgtttgttgaaggttagattaaggttggggaagtgggagggtaggttgaggttttgtgtttatagaatgaatgaatgattgattgattgattgattgaatgaatgaatgaatgaatgaaatagagttagttagttttttgagttttattttatttttttaaggtatttttagtttggtgtattgaaggttggtttattttttttttttttagaaatgtgattttttgtagtttagaagattttttagtagttattattgaatgggattttgatgatagtagagttagaggggttatttaagttttagtgaggagagaatttaggtttgagggagttgggtatttgaataggatttaatgttgtgtaaggagtaggaaggtgttttaggttttagtttttttagaggtaagattttaggttgagtaggtttggggtaggaggtttggggtaggaggtttagttttgggttggtttttttttttttgggagttagttgggtttgatattttattatttaatttttgggtttattttagtatttggttatttgggaaaggtttggagttgagtttagtagttttggaagagtttttttttagggtttttagggttatttttgttagttttgagttttggtatgtatttttaggtttgtattgttagtttttagttagtatttgttttggttatatttttgttggtttttttttgttgagattagatatagattagtttatgtttttggttttgggttttatgattttaggtaagttatgttttttttgtggttttagttttgttatttgagaattggattagtgattttaggagttttaaggtggtgatggttgggaagtttttatgagttatagattattatggtgtagagagtagtttttaagttagtttttttggttgtgggtttttgggttagttatttttgtgttttagttttttgaattgaaaaatgatatttgtataagtagttattttatgatgttattgtgaggaaatagtggtttaatttatagaaagtatttagtggtgggggttagtaagggatttgttattttagttagggttgttatttgtagtgtgatttagggtaagttattgatttttttgggttttagtttttttttttatgaagtgtgatgatgttatttattttgtggatttggagattaggggtgatatgtggatagtatgtggttgtagtatagaggggttttatgagttattgggtttgtagtgttttgttgtttttagtatttagttttttttttgtatttttattattattattagttaatggtgagtttttttatgggtagtagttgggtggttgttttggtaatagaggtgtaggtattaagtttttattgaaggaggtggtagttttgttttatgtttttaggggtagggttagtatggataggagttttagttgggttttgggtggggatgtggtatttagaagttattttagaaagaggggagttattttagaaagagggaggtatgggatggggttttgatgtttggtgggaagatttaagggattgggtaaggttggtttttttgagagttttttatgtttagtttagtttattttagagttgtttattttgttttgttgggatttttggatgagtatggagatttagttttgtttgtgggagattttagtagaattttttgtttgtttttttttgtttgggttttttagatttgagatggttttttttggggtgagttggaaggtaaatgtgtggtttaggatgaggtaataagagggagggatagaggttgggtttggagatttatggtgttagaagttaggtttgttgtattatttgagataggtgatttttttttttgggttttggtagtggttggattagtggttttatttatagaatagagtagagatggagttggggggtagtttattaggttttttatttttaggatttgtttgtttttgtttttggtatattttggttttgagattaggtttttttttatattttgggttgtagttttatttttttgtttttggttttggataaatttttggttttttgggtttttagtgtttttatttgtaagagtgaagggattagtttagtggtttttggttattgagtaatttttttttttgtgttaggttttgtgtaaagtttttagtaattgattttttgggtaattttaggagaggatagaggttagggtgtaaaattttttgtttaaggtgattgttagtatattttgggggttttgatttgggggttgtgggaagtgagggttatttggaagggtttttttattttagtgtgtttagttgttaaatggatggtattggtgtttgtttaggggagttgttgtgaaggttgattgagtttattggggtttggttttaggaagtgtttttataatttttataggttgttataggttttttgtgtttttggatttttttttttggttttttttttgttttgttatttttgattttttgaaatttgagtttgttgtggggtgaagtgggagtaggggttggttttgggagttaaggattgggaatttgtagatttttgaggttggttgtgggttttgtggttgggttgtttttttttggtgttttgtagagtgtgtttggtttgtagttaggtggttagttgggtttgaaggttggtttggtggttttttgtttgtgtggttttggtttttgaggtttttagtgttggtgttttttagagttattgggggttggttaagaagtaggttgttgagttaggtttaggattttagtaggaggggtggtgatatttggtaagtttggtatggattatggtgggggaaaggtttttatgtttttttagtttgtgtttgttattttttgtttttttttttatattttgttttggttattttggtattttggttggtttttgaatttgttagggatatttttgttttgggggtttttgtattgtttttttttttatttggaatatttttttttggatatttttagatgtatggtatatttttttatattttaaagtttttgtattttttagtagtttgtttgttttaagtggtatatatatagttttttttatttttttttttttttttttttggttttaaggttattttgagtatttattattattattttttaaggtgttatttagtttgatagtttgttttatttgttatttattttttttattttgttttgttttgttttttgagatggagttttgttttgttgtttaggttggagtgtagtggtaagattttggtttatagtaatttttgttttttaggtttaggagatttttttgttttagtttttttaggagttgggattataggtatatgttattatatttagttaatttttgtatttttaatagagatagggttttattatgttggttaggttagttttgaatttttgattttaagtgatttgtttattttagttttttaaagtgttgggattataggtgtgagttattgtatttggttttttgttgtttatgttttataagggtagagttttttgttttggtttgttaggttttggtatagttagattttgagaatgtgggtaggagttttttatagttgttttataaattgttgatgaataagtaaatgatttattaatgttattttgggtagtaggaagttttatgaagaaaaataaagttgggagaaggagtggagtgtgtaagggatggaataagggatggggtggggaggttttttgaagaggtgatttttgagtaggggtttgaagtgagtagttagtagagtgtggttgttgagggtttggtgtgggtaggagaagtgattttgagtttgtagttgggtttttgaaggttttagagtttttgtagtttttttttgggttgaggagaggtagttgttttaggtttttggtttttaagatttttataatttttaggagtgttttttgtgttaggggtagggttagtggagtttgtttagtaggagggaaggggttaattatagattttttgggtttttttaattaattttaggtttttggaagttttatttgtagttttgggagggaattgtttgtttttttgtttgttggtttttggttagtttgtttttttgtttagttattgatttggtttttatttgtttatagggggttgatttatagtagattattttaggtttggtatttgtttgtgattttgtgaggttgttaagagttgggtgtaaattttttgataggttgtagagttggttttgggtttggtgttttattttgttgttgggtagatagtggttgttgtgtttgggttatagttgtattaggtggttaagaaggttgttgagtggttttagatgggtgatgggtttggttattggagtttatattgtttttagtagatgatgttgtttttgtggttttgtttgattttgttttttttaagaggttgaatattgagttggttttttgttagttggattttatggttaggtgatttagttttttttttatggaggttttgggaagtgatgattttagtagttgagttttatgtgtgatttttttaggtttgaattttaggggtgttatatattgtgtgattttgattgtgtgtttttatttttttatttgtaaaatgggggtgatagttatagtttgttagagggatatgatttttggagatgatatgtatggttttttttgtatagtgtttggtatattatggatgtttgttaaaatggttgttatttttatgataggggtttgtgttgggtttgtatggaggtaagggggtaattttgatggttttttggtttttttagaagtattaggtatttggtgggggtaggattttaggttggttaggttggtggtggggaaggattttttggggatagtggtaaaggagttgttaatttagaatttagttttggttttttagtttttatattgtgtgattttggtgagtttttagattggttggggtttagtatttttgtttttattttggtttttattatatgtttgtgaggtgggttatttttattgtatagatgtattagagaggagttgtttgtttaggagtagatggttaagttagaatgggaatttagaatattttttttaaaggttaaggtttggtgggttgtgtaatttttgaaattttttttgatttttgggggttagaggtgtgatttttattttgtagataagatagttgaggtttagaaggtaagagtggtttgtttaagatagtgattattggtgggtgagagttgtttggtatgagtttggggttattgggtttttgggaggggtaggttgggatttgtttttttataagtgagggttatagatattaatttaggttatgttggaggagttgtttgatttgagtttagtagttggaggttgatagtagttaggataggttttgagggttaatgtggggttttttttagttattttagttttttgtttttaaaagtatgtggtttgttttttagtttattggtatttttaggggttagatagtatgataattattttatagatgtggaaattgtggtttagaggtagagagtgatttggtggtttagagtagggtatgattggaaattgtatttttaattttgagttttagagtagggaagggtttttggtggagtttattgagatttttttattttttttttttaagttttatttttttgggtttgtagatagtagttttgggtttggggttggatggggttttaatatttattgtggagttttgatatatttattgatgtattgaatttaggttggttgtgaattttgtttttttttgttataatagatgtgtttttataggttttagggagagtaggtggttgtgtgttttttgtttgattttgagtttattggttgtttagagttttagtttttttatttatatgataggatggtggtagatattatttaaggggatgttgttaggtgaaataagatggtgtttgttagttgtttagatgttgttgtggaggaagtatttagtaagtatttgttgttgttttgatgatttttatttttgttggtgattgttttaaaggatagttttagtttgtagaggtgtgatggggatttattgtgggagaaggggggttttttggaggaggggtttttggattgggttttataggatagaaagtattgttggtagaggttgttttgagttgaggttttgaagagtggggggtagagaatatttaagaaatattgggaatagtagtagtaggaagaagtggtagtgggtgggttttggggttagtagttttgtttttttttttttttggggtttttttgattagtggttgatttttgttattttaaattagggatttttaaaaggaaggggttttagtgagtagattgtgtagaggggaaattgaggtgtagtaggattgggtttaaggtgatggagtgggttagagttagagttttttatgtagtttttgttttgggtaattgaatgaaagaggttttttttgaagattattttttttttttaggtattggaatttttgttttatttttagtgtgagagttttggttttgtggttttgagattttttggtgttttggttatgtggggttgttttggttttttttttttttttttggtagtggttttagtgttttatagtaataaggaagttatttttgaagtgttgttggattttttttttttgggaagtttgttttatggagggtaagggagtatgtggtgggagtgtgggttttggggttagattatttgatttatagtttgggttttggaataggtgtttagtgttggttttatggtgaagttttggtggttttgtttaaataatgggaataaaagggaaagtgttaggaaaagagttttgggtttggagttgggggatttgggtgtgaattttgttttgttgtttaggttttgtgttttttatatgattttagtattttggtttttatattttggtttttagtatggggatgatagttttgttttttttgggtatgagtagagataaaagtgatggttatgatggtggtgatttatgtgattggaaagtgtttatattttaggttagtattttaatttataaagatagtgtgatggggatattgtagtttggggtgggggaaaggagtgtgatttgagtgaggttattagattgtaagtgataggatttgtttttgaatttaggttggttgttaattttgtttttttttgttaggttgtaggagtaattgtaaatattttttgtatatggtgtgatttagaaataggggattttatttttttgtgatgaaagtaataaggtttgaggttttgtattagttttattggttttttttaagtttgtggttgattaaaatatttagattttttgtatttaggttgttgttggattagtttgtggtttttatgtttatttggtaggttttatgtttgttaagatttttttgtttatttgttttttagtttatttatatttttttgttatttttagtggttttaggagtaaggataatattttttttaaggtttgttagggttgaggatttggtttggaattggaagttttggttgtattgggtttgttttttttagggtagtagttaggtgttttttataaggtattttttttttatttgttttaggttttatttattttatttgttttgtttatgtgatttgttttatttttatgggtatttgagtttgtagttttagttttagttaaatttgtttttagtttatgtttttttttttgttgttaagggttttgggaggtagtagtgggggtttggttagagattaaatggttttatttttgttattaagtgttttatggatttttggtttggggttttattggaggagaaggtggggttttttggtttttggtgattggttgagtttttgtggtttttaggttttttgttttttttttgaggtttttagatatttgtttgagtttttaatagggatgtgtagggagtttgggggtttataagtattagaatttattgtgtttttattttgaaaattagaaattaggtttatgtgaggttttgggttttgtttttttatgttttatagtggttgataggttttttttattttttgagtttttagtaattatttgtttaggttttaagaagtgtagtgagttttgttttattttttatttatattttgttttttttttttttgttaaattagaaaatgtatatgttattttagatttaaggttttaggtaaattttttttttttttttatttttttttatatttttttttttttttttttttgagatggaattttgttttgttatttaggttggagtgtagtggtgtgattttggtttattgtaatttttgttttttgggtttaagtgatttttttgttttagttttttaagtagttgggattataggtgtttgttattatgtttggttaatttttgtatttttagtagagatggggttttattatattggttaggttggttttaaatttttgattttatttaggtgatttgtttgttttggttttttaaagtgttgggattataggtgtagttattatgtttagtttttattttttttaaagggttttaggtttaggaaattttattttttgtttggtgtgtggtttttaataagtttttttgtttttttgtagttgtagtttttttatttgtaaaagagggtttggttattttgtttgattggtagttttttattaagttatgtgaggtagaatggttgtgattgtgttagggttgattagttgaattttggagtgtatagttttttaagggagttgttttttttttgggttagttttggagaagttgtagttattagggggtgtgaatagggatgtttttgggagtgttgtatgtaagggaattaaaggggaagtttgagaaggattgaaatgtgggtggagaggattgtggagtgaattgtgtttttagtggttagtaggaaagagggagagtagtgttatttttgttatgtttgttgaattttttttgtagtagggaggatttttagggttttatgggaattttgttatttttgtggggttggattattgtttttattttgtagatagggaaattgagtttgagttttaaggtgtgttattaagaaagtaagttatagaatgatatatttggattgaggttgtttaagagagttttatgagaagtttattttgtgttttttatttatggaagatgaaaaatgtttggaaagaaattggttatggtggggattttggagaggagtttagagtggtggatagagttttatttgtaatgtttttatttttgtaaatatttatgtgttgtttgtgaaatgtaaaattagtaattaaaaaagtgtgtgtggtgggggaggtttttgtaagtttgatattattttagaagtgttttttggttttagtaggttgtaggagggtgggagtttggttattttgatttttttagtatttttgagtttttggatgtgaggttgggattttttttgtgtgggttttggtagatagggagtggaaaatgttggtagttttttttaggtgtgatattttgttttttgattttagtttttaggtagagatggttgtttagttttttatgtaagttttttatatttttgtttagtattttggtggagttatttttttgtttgaggtttagagagaagaaggtatgttttggggattttagagtgatttagggttggaaaagtttgtagtttttttttggggttattttttattgtttttgtagatatgggagatagtgtgtaaggtaggttgggatgttgggaggtagagggtggtagtgtttttgggttatttttttgttttttttgggggtatgagttatttttttatgtttgttgttttagttttttttttttagatttagggtttttgttttgttgtttagattgggatgtagtggtataattagtttattgtagtttttattttttgggtttaagtgatttttttgttttagttattttagtagttgggattataggtttgtgttattttatttggttaagtttttttttttttttttttttttttaatttttgtatagataggggttttgatagttgtttaggttgattttaaatttttgggtttaattgatttttttattttagttttttaaagtgttgagattataggtgtaagttattgtatttggtttttagtttttttttttgttaaatagtgtgttgtagaggtttggattattgtgtgttgtagaggtttggattattatatgttgtagaggtttggattattgtgtgttgtagaggtttagattattgtgtgttatagaggtttagattattgtgtgttgtagaggtttggattattgtgtgttgtagagttttggattattgtgtgttgtagaggtttggattattgtgtgttatagaggtttggattattgtgtgttgtagaggtttggattattgtgtgttgtagaggtttggattattgtgtgttgtagaggtttggattattgtgtgtggttgaggtttggattattgtgtgttgtagaggtttagattattgtgtgttgtagaggtttagattattgtgtgtggttgaggtttagattattgtgtgttgtagaggtttatattatagtgtgttgtagaggtttagattattgtgtgttgtagaggtttatattatagtgtgttgtagaggtttagattattgtgtgttgtagaggtttagattattgtgtgttgtagaggtttggattattgtgtgttgtagaggtttagattattgtgtgttgtagaggtttatattatagtgtgttgtagaggtttagattattgtgtgttgtagaggtttagattattgtgtgttgtagaggtttagattattgtgtgttgtagaggtttggattattgtgtgttgtagaggtttagatatgtggggtggtatataatgattattttttgtttagaaagttttttgaaaatttttgtgaagaggttggtggtgattttagggtttttttagtagaggtttaaggttagattttaggaagaattttttagtagagtgaggtatttttgtttttattgagattttggggaagtaatggttgatgggttttttgtgttttgtagggtattggtagaagttggaggattagattaagttgttttttgattgttttggggatttggaatggttgtgtatgtgggtgatattgagtatatttagtttttgaggtttatttagtattataagttattttagtagttagttttagattttaatttaaggtatggtatggagggaggggttgtagtggggtgaggtgggggtggagggttttgatgtggtttaatttgttttagattaaaagtttgtttgaagattagttattgtatttttttgttttgtagaggagttgttggtgtttattggtatttgtagatggtttttgtgggttttttgtgtgttagttattatttgtttatttagtaaatattgatattattgatatatgtttggtgtttggttttagggatttgtatattaggagtttattgtgtttggggaaatggggttaattttatagtgtttttattaaaattggggtatgatttgtttaaggagttgtgatagatttgtttttgttatgtatagtttttttatttttgttttatagtttgtgattttttatttgaaagtggattggggtggatgtttttatttagggttgggatgatatttaaatgatattattgtatttatataaattttgtatattgttaagtgatattttaattttagagaggtatatagtatttttgggaaaggttttttattttgtttagagtatttttttaaataggaggagttgaggtggaagggaagattgagttggggtttttatttttattgtttagatggatatagtaagtatagttgtagttaggttttaggtaggttttttggagtattgaggtgtttggtgtatagtagttgtttattaaatggttgttggttgtattttttttttgtttttttagttagtgagttggggatatgggaggttgtgtgtatagttggtttttgggttaagtggggtgttaagggtgtttggtggttgggtggatagaggtaggtagttggttgttgttatggattgtgtttatttttttttaattttttagagtttggttagaattttttggtagatgaatgaattgagaggtttaagaggtttagagttatttttgggttatatagtttatttgtgattaggtttatagtttttatagtatttgtttttaagaattttttgtatttttgaggggatagataaaggggtttggaatagggttgttaattggtttgtttgttttatttttttttttggtgttatgttgaggtgggggttgattgggtttttttattgatattgttttaggtatagtgttgtagttaggggttggatgtaggtttttagtgtgaagagaggatttttttttttttggtttgggtttaggatttttggttttggttttgttgagatgttaaggttgggagaagttttaggtttagtttttttgagtttaggagttagtgtatttgagatttttagtttttgagtttaggagttggaggtttgtttttaagaggtagtggaaggagttttgtatgttgtgtttatgtttatttttgttgtgtagttgtttttgtttttgttatttatgggttagtatttgttgaggtgtagtagtttgagagttagtttttttttgttatggatagagttaggttaggggattggggtttagtgggggagttagaatttaggaggtggggtgaatagtggttttttgtttattagtttttatggaaggagagtttatatttgtttatttattgttgggtgggtatagtttgggaattaatgtttggttttatggtaggtatagttgttgtttttattttgggttgggaggaaaggagtttagtttgtgtggggtagtggttgatttttgtttttttgtttgtttttttttgaggtttggtttagttttttgttagttttttatagtattgggttataggtagttaggtatttttatttttaggtttattttttttgggtgagagaaagggttttggatgattaggatagggtgagtatgaattttgtagttagttggattaggttaggaatttaggttttgttaggtattggttgtatgattttagataagttatttaaatttagttttagtttttttatttgtgaagtggggagaaggaggtttttgataaagaggggttgttggtagatttaggtttgggaagttatttttataggtttttttttttttgtttttggatttttttttggggattttttttgggatattttattattattttttttggtgtttgttaagtgttttgattttttaatattggttattggtaagtagtgtagagattttagtattttttatattttagttttagtttttagttgtagttgtttataatgggggttttttatagttgaaagggtttatttagttattatgtagtagtttggataatttggagaagaaaataaatatttttttttattgttgggattggttatttgatagtgttttgggtagtttgggttttttggggttgtgaggttgtagggtgggggtataggagttttaaggaagttgttggggggtttgagggagtgttgagggtaggtattttttttattattttggaggaggggtggtggttttgaggaaagaggttggaggggatggtggtaggtttagggaggtttagtttagtgttttgtagtttgtgtgagttttgaggggtatagttttgttgttgtattttgtggtttttatttgttttttttgttttgagaatggggtttttattaggtggttagtatttatttttattttatttattttagttgtgttgatgtgtttagtatttgtaataggatttttttttttgaggggttttttagatgaaaattggtagttaggtgttttggaggtttttggttttaaggggttgggatagttaagtgatttattagggaatattttagatgttttagaaggtttttgttatttagattgttgtttttatatttttttattttaagttaggagtattattttgtttggatttatgtttagggttagagtatgttgttgagggaaatatattttagttgatttgggaagattttaaagttttgagaagttttaagttttagttgaagttatatatattttaggtttatagttttttgtttttagttaagttttggtgtggtaggtagagtttattttggttagtattggtttttattttttggtgggtgatatagaggggttgttgggttggatagattgtatttttggattattgttgggggtttatttattttttttggttgttagagtagaagggaggttttgtattagggttttaatttggtagggttttgaatgagttagtttttttgggtatttagagtaagagatattatagttatagtggttttgtaaagttttatggatttttgttttgtgtttagtgttattttaagtatttgatgtgaattaattgaattttgatgaattgttattgttttatgttttatatggggaaattgatgtgtagagaggttaagtgatttgtttaaggatataaagttagtaagtgtttaaattaggataattgtttggttttagaagttatatagtaagttttgattttgtgttgttttaaagatgggatagtttttttttaagtatgtgttggggtttaggattagaggttttaggattgtgtgttaggtttaatgtgttgtgtgattttgagggaagtgttttattttgtttgggttttagtttttttattaagggtgttagatttaatttttgagtttttttgaatgttgaggttttgggggtttgtgatgataaaagttggggatagaggatggaatatttttgttttggagtttattgagaagttatatttttgggggagtaggggtagagtttgggttggatattgtgattaggttggggtttgggtttttaagtttgtttgattgttgttttattttgttgttaaggtaggttagggtggtatttagttattgtgtggttatgagttggttttagagatataggtttagggtgaggtggaggttagagtttttgtgaatttagtgtttataatttaggtgtgagtgtatagaatttttgtgtgttgtatttgggtaggagaggtatgtgtgtttttagtagaggttttgtgatgagaattagttttttttttgttatagagatttagttttgttttttttttgtttttatttttttgtttttaaaagtgggttttaatttttagttttatatggttattggagttttttatatatttatggtttttttagttgttaatatgggttggtggggagaggaatttgtttgggtagggttgttgggaggtttgagttgattttgtttttagttttattattgtattttaggttttttttttgtgaggttgggaaggaggatttaaaaagaagaatagatttttttttttgttttgttgttgttgtgggggggtttttatggttttttttggtttggggtatgttttaattagttttttggtaggtttgtgtttggagttttggtgggggaggttttgggtagtttagggtaggaagaggagagttaggtttagaattaggggttttttagatgggttttgggaattagagtttaaggttattttttaggaagtttttttggggttgttttgagttggaattgattttttttttgttgttttttaggtattttggaattgaatttattttttgatttttgttagtttgattgttttttttttatgttgttaatttttatggagagttgttttttagattttaggatgtattattttggggttatgttagttgtttttttttatagtgttatgtttttgggtatgagtattagtagttttagtgtggtgggtatgttggttattagttgtttttattatatttattttttgttattttatttgggggttttgtagaattagagtgggtttttttaggttaatttgtttttttattatttttattatgggatattttttggtttttattagttttttatggtggttggtagtagtagtgggggtgattgtttatttatttgtatgttggttttttgtattagtagtgttgtttttgttgttgttggtaattttatgaattttagtttgggtggttagagtgatggtgtggaggttgatggtagttatagtaatttatttatggttttgagtatgttaggttgtatggatgaggttgtgtggtggttttattgattgttttggtggattttttttgttggaggtggggattttaataatttttaagattagtgatgggttggttttgaggttttgggtgggaatgggatttgtgttttagggtggttttggttttagggtggttttagttggtgggagtttttggttgtatttgtgtagttatatttttgtatagaggtataggttattatttttattttggtttgggatattgtttttggtttagattttggttgttttattttatatttttgtggggaattagttttttgttatttttttggaaggattttattgtttttagttatgtttagtgttgtatgggatttatgttttttgggatagaggttattttttttttagagagaggtagtattggtttataggataagttttaggttttgggaaattttttgatttttgtatttttgttggagtttttgtattttttgggtttagttttttttgtatttatatagatttgagttagaattggaaagtgttttttatttttattatttttgagtggggttttttttattgtatagatggggtaggatttagtatgttgttggtagagatggtttgagaatatatttaagttagtttttttagtttagttttttttttgtttttaattgttggtttttttttagttgtatgggttttaggttttagagaagatgagtttatggtattaggtttttaaatttaggaaagtatttatagattggtttttttatgtattttattagtttaatgtatttattttttgtttttttggtagggtgggggaggggggataggaggtttttttttttttaggtggttttataattttatttgtggagagaataggagggttagatagataggttttagtagaaggtattgaggtgagggattattttgggttagatattaatgtttttgttttttttgggtttagttaagttgtgttttattttttaagttttttgggaggatttagttaaattttgtgatttttggtatatatttgtttgtaatttgttttgtgttttgaaagtaaatagttttgagtaaaaaaaaaaaaaaaataaaaaaataaaaaaaaaataaaatagtttttaaaattgattttagaaaaagaagtttaatttaatgtttttaaatataaggttttttataggtatagttttgtgattatgatagttttgtgattataagtaatatttttgtttttttttttttttgtggatttttagttgttttttgagggtgtggggttattagggttttaatatttttttaaggggttatattttttattaggtagtattttattagtttgtattataggtttttttgggaggatgagggaaatgttgatgagatgttgggtattttttttttgtggttttaggatatttgtttaggaggttgggtggaggtgggtaggatgtgagaggtggggagtattggttgtgtgtggtaggatagaagtattgtaaagggttttttagttgtagtttagttgtattgtgttttgaggtgaagttttgtttttgaattttgtaaaatgggaaagtgggtgtttgtttaagggttaggttgtatggatttttatattagagttttttggttttagaaaggtttagaaaaggtgtaagggaatttataaaggttagtagtatgtggtattttaattttttgttttggtttttgtggatgtagaaatttgttttataaaatgttttttattggttgtttttgtgagagtattgtttttatttaatttgttataatggttagaattatatattagagatatattggtaggttaggtagtttttttggtgattttattttatttttttttgttgtggttttttttggtttgtttttattggaaaaatagtttttatttttttaaaatagttgttgattttttgtatttaaggggtttttttatgtttttttaggaagtagttatgaatttattgtttttgtagtttttttttttttgttttttggttatagttggttttaggttagtgtgggaggtatttttgggtttttagtgtttagtattttgtagttttattttagattattaattttttttgattttggagaggtagggatagtaaataaattgttttttttattttattttttattttttgataaaaagtgatggtagttgtattgagtttgtaaggtttaaagtgggtatagatagtttgggttggtaaaagtaggtttttatttataaggttgtgttaaagttgtattaggtaaatatattgatgtaggaagtatgaggaaaggaagatgttttgatatagtgttattgtgagtttgttagtagtgggtattaattttttgtgatatattgttatgttgaggtgtgatatttgttgtatttatttgatgtaaaattattttagagttggtgagaggatggagttgggtggaaattgttttgtattattgtttgtttggtgtttgtttttaatgtataatttgtttgtatagtaaattgttttttgtattatttaattgtaaaatggaattttgattgatttgttataataatataattttgagatgtgtggaaggagtttagtgtttggtttttagggttatgtatggaggtggggtggggtgggggagaggatggagattttttgttgttgtttaggaggaataggaatagagatatttagtatttttatttttttgtttttaatttttttaggaatggttgtagagattattttggttataggatagttggtgaggtttgtttttgt

SEQ ID NO: 252 - DNA, 3966 bp, Artificial Sequence
  Chemically-Treated DNA
atatatgttaaaattagattaattgtttttttttttggagagttgtgggtggaattgtgagggatgtttagttatagggtaggttttgtatattatttgtagtttagtaggttagttttaggatttttttttttggatttgtttagaattaagttaaatttttggttaaagtatatttgttagaaaatttatttttttttaaaaaaaaaatttttataataaagtttattatttaaattgattttaaaaaatataaaataggattttgtatagtagaaaaataaagttagagatttttttttaatttttggtttgtgtaaagatattgggtatatgtaaatatgaagaggtaggaggtgtgagtttaggttttggttttagatatagttaagttgttataataattagggggatttagagggagtattaggagggggaggatttttttaagaggtgagaaggggtttgtggttttgtttttagttgagggtgggaggtgttttgtttttatatttatttgttttttttaatttaggttggggagggtatttatatggttttaggtaagtaataataaaataatatggtattttagttaatgttgtgtgtatggtgggtgttgttggttaaatttggaaggggaaggagtttaggtagttgtggaggatggggttgagggggatgtgagttaggtttttgtggtttatggtggttatgatgtgttggtggtatagtttttgtagtggttgtatgtggtgttggtgtagtggggtttttagtatgtggtgtggtgttgttatgtagtgttttagtagtttgaagaggtagttgaagtttttgtggttgttatttaggtgaaagtggttggtttgaaagtgtatgtggatgtttgtgggttttgaggttatttttatgttaagggtgaaaaagtagttttgttggtggttgttgtgtattaggaaggtgtttatgggtttggtgtgtagttgtttgtgtgttttgtgtatgtttaggggtttttagtagaatttgtaggtgtttaggagtgtgttggtgtgtgtgatgtgttggtaattggtgtgtgaatggaatgtgtggaagtgtgtgttgttgggggttggggttgggattgtggggtatggttgtgggtgtgtgggggttgtgggtgaggaggaggaagaggaggaaggttttggttgttgttggggttttgttgttgtggagattgtattgttggttgttatttggttgtgtgttattattttatagaaggggttagttggaggggtgggttatagtgtttgggggtgtgttgtgggagagataaagaggtgagttggggtgttgtggggttgggtaggtgtgtgttggttggataattttggagggtggtgtttttggtggatttggttttagggggtgagtatggagtattaagtttgtgtggatttgtttagttttagtggatatagttagaaaatgggttttgtattttgtggagttttttttggtgggtgggggtttggtggaggtggagtttggtttttgggtagtattgagaggggggtgtggagagtagttggttttggttttagttgtttggttttggtttgttgttttgtgtttgttgtttgttggttaggttgggatttgtgtttggtttgggtgatttgggttagggttggagaaaggttgtgttgtgggagttttgtgtgtggggggtggtttgggtggggttggtgagggttaggggtattgtggttgtgattttattttgtagtttttgaggtttgtttgatttttggttgttttggatttttttttttttttttttttgtttttttgtttagggtttggtttatttggtggtggggtgtgggatgttgtgggtgggatggtggggggttttggggtgttttggggtggtttttgtgtatgttttggggttaggagttgtgtagttgttatggttgtagtttgttttgtttggtgtttgtttttgtgttagttttttaaattggtttggaggtggggttggtgatggtgggaggttttgttttttgttggttttgtttttagttttatttttggtttttttttttgtggtggtgtttggtgaggattgttttggttttgttttttttttttttggatttttttgtggggttttttgtttgtttgtttgtatttgttttagtatttgttttttgaggggttttggttttgattttgtgttttttggttattttttggattttttttttggatttggtgattttgattttgttttgttattttgggttttattttttgttgttaggtttttttgggatgtgttttgatatatttttttttgttttagttgtttttatatttgttgggggtagagttttgttttttttttttttgtagttagatttttttaggaggttatagaaggtgtttttaattttgagtttgattttatttgtagatttttttttagtttttgttttatttgttgttgatgtttttagttgtttgttttgttgttttgaagttttggttggttgtggtttttggttttggtttgggttttttgggaagtggtggtttgattataggttttagaggaatttttggtggtgtgggtgtttttattttggtttagttttttggaaattgggtggggttgggtaaggtttttggtggttttgattgttttttttgtgtttttattatttggttgtggaagaaattgaggttggggaggggttgggatttgtaatggtttgtagattgggagttttggatttggattttgttttttttgtttttattttggggagaggtgtagttggatgatattaaattggagtttagtgaaaaaatggtgtatttttagatgtgatgaatttttaaatttggttttttagttttttttttttttgattttttttttatagattttttttttttattgttttgttaggtatttgttttttaaagattgtttttttattatatatatggttggggtttgggatggtgggtggttggtggttggggttgtaatttgtatatgtgtttgtgatttagtgattttgattgttgtgtgaggttatggagtaggtgtttggttgttttgtgtatttttgaatgaaggtatgtgaggagttttagtattataaggggttatataaaaatttggttaggttgggtatttggttattggttttatattgggatatattgttttttatagatagtttttagatggttttttttttggaagttttggtgtttagtttttttttgtttttttggttttatgatatttttttttttaggtagagtttaggtttttattaattttttgaatatagggagtggtttagaattagtttagtttagtattttattagtgttttgaatttgtatgtggttagggttggtggtggttattggtgtagttttttaggttgtgtgtgtgtgtgtgtgtgtgtgtgtgagggggtgagagaagatgtagaattttgtttgtattagaggttaggtgtgtgattatttgagagatgtttattgaatatttgttggaggttatattttgtggagggtgatggaatataaggagatttagttttaaatttgtatttttttatttttgtgattttgagtatgtaattaatttttttgttatggtttttttatttgtgaaatggggataataatagtatttttagtagggtgtagtagtttatgtttataattttagtatttggaaggttaagataggaggattgtttgagtttaggagtttgagaatagtttgggtaataaagtgagattttttttttataaaaaaaaaaaaaaaaaaaaaaaaatagtataaaaattagttagttgtagtggattgtatttgtagttttagttatttgggaggttgaagtaggaggattgtttgagtttaggaggttaaggttgtag

SEQ ID NO: 253 - DNA, 3966 bp, Artificial Sequence
  Chemically-Treated DNA
ttgtagttttgattttttgggtttaggtaatttttttgttttagttttttaagtagttgggattgtaggtgtaatttattatgattggttgatttttgtattatttttttttttttttttttttttttgtagagagggggttttattttgttgtttaggttgtttttaaatttttgggtttaagtaatttttttgttttggttttttaagtgttgggattataggtatgagttattgtgttttgttagaggtattattattatttttattttatagataaagaaattatggtagagaggttaattatatgtttaaggttataagaatagaaaggtgtagatttggaattgggtttttttgtattttattattttttatagagtgtggtttttagtagatgtttagtggatattttttgaatgattatatatttgatttttggtgtaggtaaggttttgtatttttttttatttttttatgtatgtgtatgtatatatatgtataatttaggaggttatattaatgattattattagttttggttatatgtagatttagggtattgatggggtgttaagttgggttgattttgggttattttttgtgtttaggaggttaataaggatttaggttttgtttggggaaagaggtattgtggggttagggaggtgggaagggattgggtattagggtttttaggagagaagttgtttgagagttgtttgtagagggtagtgtgttttagtgtgaggttagtaattaagtgtttagtttagttaggtttttatgtggttttttgtgatgttggggttttttatatgtttttatttaaaaatatatggagtagttaggtatttattttatggttttgtatgataattggaattattaaattataaatatgtgtgtaaattatagttttgattattgattgtttattattttaagttttggttgtgtgtgtggtgggaaggtagtttttgaagggtagatgtttgatggagtagtaggagggggaaatttatgaggaaggggttgggggagaggagggttaggaaattaggtttggggatttattatgtttgagaatgtattatttttttattgggttttaatttgatgttgtttagttgtatttttttttaaaatgaagatggggaaggtgagatttaggtttagagtttttaatttgtaagttattgtaaattttagtttttttttagttttagttttttttgtagttgggtagtgggagtgtagggagggtagttgaggttattagggattttgtttggttttgtttagtttttgaggaattgggttggggtggaggtgtttgtgttgttaggggtttttttgaagtttgtggttaggttgttgttttttgggaagtttgagttaagattagagattgtggttggttggggttttgggatagtagggtgggtgattgagggtgttgatggtgggtggagtaggggttaggagggggtttatgggtggggttaggtttagggttggggatattttttgtggttttttagggggatttggttgtaggggaggagaggatagggttttgtttttggtgggtgtggagatagttggggtggaggagggtgtgttagggtgtgttttaagagggtttggtggtagaaagtggaatttgaggtagtggggtaaaattggggttgttaagtttgaaggaggggtttgagaagtggttggaaggtgtagggttggggttagagttttttgagaggtgggtgttggggtaggtgtgaataggtgggtagagggttttgtgggagggtttagaagagagggaaatagggttgaagtggtttttgttggatgttattgtggaaagagaaattaaaagtggagttgggggtggggttggtagggggtggggttttttgttgttgttagttttgtttttgagttggtttaaaagattggtgtaggggtgggtgttgaatagagtgagttgtggttgtggtagttgtatggtttttggttttggagtatgtgtgagagttgttttggagtgttttggagttttttgttgttttgtttgtggtgttttgtgttttgttgttaggtgagttgggttttgggtgaggaggtgggagggaggagggaggggagtttagggtagttaggagttgggtgagttttgggggttgtagaatggggttgtggttgtgatgtttttgatttttgttggttttatttaggttgttttttgtgtgtggggtttttgtagtatagtttttttttggttttagtttaaattgtttagattaggtgtggattttagtttggttagtaggtggtgggtgtggggtggtgagttggggttggatggttggagttagaattggttgttttttatgttttttttttggtgttgtttggaggttggattttgtttttattgagtttttatttgttgggaagagttttgtggagtatagagtttattttttagttgtgtttattgaggttgaatggatttgtgtggatttggtgttttgtgtttgttttttagggttgggtttgttgggagtgttgttttttggagttgtttggttggtgtatatttgtttggttttgtagtgttttagtttatttttttgttttttttgtagtgtatttttggatgttatggtttatttttttggttggttttttttgtaggatggtagtatataattaggtggtagttgataatgtagtttttatagtagtagagttttgatggtggttagaatttttttttttttttttttttttgtttgtggtttttgtgtgtttgtggttgtgttttgtggttttggttttggtttttggtgatatgtatttttgtatattttgtttgtatgttgattattggtgtattatgtgtgttagtgtgtttttggatgtttgtggattttattgggggtttttgagtgtgtatggggtgtatgagtggttgtgtgttgagtttgtgggtatttttttggtgtgtgatagttgttagtggaattgtttttttgtttttagtgtgaagatggttttgggatttatgagtatttgtgtgtatttttaggttggttgtttttatttggatggtagttgtgagagttttgattgtttttttgagttgttggagtattatgtggtggtgttgtgttgtatgttgggggttttgttgtgttagtgttgtgtgtggttgttgtaggagttgtgttgttagtgtattgtggttattgtgggttgtgagaatttggtttgtattttttttaattttgttttttgtgattatttgagttttttttttttttagatttgattggtagtgtttgttgtgtatgtagtattaattgggatgttgtgttattttgttattatttgtttggaattatgtgggtattttttttggtttgggttggagggagtggatgggtgtaggggtgaggtgttttttgtttttggttggagatgaggttgtagatttttttttattttttgagggggtttttttttttttggtgttttttttgggtttttttggttgttgtagtagtttaattgtatttggagttaggatttgaatttgtattttttatttttttatgtttatatatatttagtatttttgtataaattaggggttgggggagggtttttggttttatttttttgttgtgtagaattttattttatattttttaaagttagtttaggtaataaattttattatgaaagttttttttttaaaaaaaaataagttttttagtgagtgtgttttggttaaaagtttaatttggttttgaataggtttaggggagagggttttaaggttgatttgttgggttgtaggtggtgtatggggtttgttttgtggttgggtattttttatggttttatttataattttttagggagagaaatggttggtttagttttggtgtgtgt

SEQ ID NO: 254 - DNA, 6492 bp, Homo sapiens
  CDS (494)..(1213)
tttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgtaccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaatcaatggtggggaactataaagaagtaacaaaagaagtgacatcttcagcaaataaactaggaaatttttttttcttccagtttagaatcagccttgaaacattgatggaataactctgtggcattattgcattatataccatttatctgtattaactttggaatgtactctgttcaatgtttaatgctgtggttgatatttcgaaagctgctttaaaaaaatacatgcatctcagcgtttttttgtttttaattgtatttagttatggcctatacactatttgtgagcaaaggtgatcgttttctgtttgagatttttatctcttgattcttcaaaagcattctgagaaggtgagataagccctgagtctcagctacctaagaaaaacctggatgtcactggccactgaggagctttgtttcaaccaagtcatgtgcatttccacgtcaacagaattgtttattgtgacagttatatctgttgtccctttgaccttgtttcttgaaggtttcctcgtccctgggcaattccgcatttaattcatggtattcaggattacatgcatgtttggttaaacccatgagattcattcagttaaaaatccagatggcaaatgaccagcagattcaaatctatggtggtttgacctttagagagttgctttacgtggcctgtttcaacacagacccacccagagccctcctgccctccttccgcgggggctttctcatggctgtccttcagggtcttcctgaaatgcagtggtgcttacgctccaccaagaaagcaggaaacctgtggtatgaagccagacctccccggcgggcctcagggaacagaatgatcagacctttgaatgattctaatttttaagcaaaatattattttatgaaaggtttacattgtcaaagtgatgaatatggaatatccaatcctgtgctgctatcctgccaaaatcattttaatggagtcagtttgcagtatgctccacgtggtaagatcctccaagctgctttagaagtaacaatgaagaacgtggacgtttttaatataaagcctgttttgtcttttgttgttgttcaaacgggattcacagagtatttgaaaaatgtatatatattaagaggtcacgggggctaattgctggctggctgccttttgctgtggggttttgttacctggttttaataacagtaaatgtgcccagcctcttggccccagaactgtacagtattgtggctgcacttgctctaagagtagttgatgttgcattttccttattgttaaaaacatgttagaagcaatgaatgtatataaaagcctcaactagtcatttttttctcctcttcttttttttcattatatctaattattttgcagttgggcaacagagaaccatccctattttgtattgaagagggattcacatctgcatcttaactgctctttatgaatgaaaaaacagtcctctgtatgtactcctctttacactggccagggtcagagttaaatagagtatatgcactttccaaattggggacaagggctctaaaaaaagccccaaaaggagaagaacatctgagaacctcctcggccctcccagtccctcgctgcacaaatactccgcaagagaggccagaatgacagctgacagggtctatggccatcgggtcgtctccgaagatttggcaggggcagaaaactctggcaggcttaagatttggaataaagtcacagaattaaggaagcacctcaatttagttcaaacaagacgccaacattctctccacagctcacttacctctctgtgttcagatgtggccttccatttatatgtgatctttgttttattagtaaatgcttatcatctaaagatgtagctctggcccagtgggaaaaattaggaagtgattataaatcgagaggagttataataatcaagattaaatgtaaataatcagggcaatcccaacacatgtctagctttcacctccaggatctattgagtgaacagaattgcaaatagtctctatttgtaattgaacttatcctaaaacaaatagtttataaatgtgaacttaaactctaattaattccaactgtacttttaaggcagtggctgtttttagactttcttatcacttatagttagtaatgtacacctactctatcagagaaaaacaggaaaggctcgaaatacaagccattctaaggaaattagggagtcagttgaaattctattctgatcttattctgtggtgtcttttgcagcccagacaaatgtggttacacactttttaagaaatacaattctacattgtcaagcttatgaaggttccaatcagatctttattgttattcaatttggatctttcagggattttttttttaaattattatgggacaaaggacatttgttggaggggtgggagggaggaagaatttttaaatgtaaaacattcccaagtttggatcagggagttggaagttttcagaataaccagaactaagggtatgaaggacctgtattggggtcgatgtgatgcctctgcgaagaaccttgtgtgacaaatgagaaacattttgaagtttgtggtacgacctttagattccagagacatcagcatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactg

SEQ ID NO: 255 - protein, 239 aa, Homo sapiens
MAHAGRTGYDNREIVMKYIHYKLSQRGYEWDAGDVGAAPPGAAPAPGIFSSQPGHTPHPAASRDPVARTSPLQTPAAPGAAAGPALSPVPPVVHLTLRQAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWDAFVELYGPSMRPLFDFSWLSLKTLLSLALVGACITLGAYLGHK

SEQ ID NO: 256 - DNA, 1207 bp, Homo sapiens
  CDS (494)..(1111)
tttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggtaggtgcacttggtgatgtgagtctgggctgaggccacaggtccgagatgcgggggttggagtgcgggtgggctcctggggcaatgggaggctgtggagccggcgaaataaaatcagagttgttgcta

SEQ ID NO: 257 - protein, 205 aa, Homo sapiens
MAHAGRTGYDNREIVMKYIHYKLSQRGYEWDAGDVGAAPPGAAPAPGIFSSQPGHTPHPAASRDPVARTSPLQTPAAPGAAAGPALSPVPPVVHLTLRQAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWVGALGDVSLG

SEQ ID NO: 258 - DNA, 3972 bp, Homo sapiens
  CDS (228)..(1031)
gctgccgccgccgcgcccgggcgcacccgcccgctcgctgtcccgcgcaccccgtagcgcctcgggctcccgggccggacagaggagccagcccggtgcgcccctccacctcctgctcggggggctttaatgagacacccaccgctgctgtggggccggcggggagcagcaccgcgacggggaccggggctgggcgctggagccagaatcggaaccacgatgtgactccgccgccggggacccgtgaggtttgtgtggaccccgagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaaaaaaaaaaaaaaaa

SEQ ID NO: 259 - protein, 267 aa, Homo sapiens
PPPGTREVCVDPEFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 260 - DNA, 7825 bp, Homo sapiens
  CDS (373)..(7506)
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctag

SEQ ID NO: 261 - protein, 2377 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 262 - DNA, 7756 bp, Homo sapiens
  CDS (373)..(7437): coding sequence for CAGNA1G alpha 1G subunit (isoform 2)
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctag

SEQ ID NO: 263 - protein, 2354 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 264 - DNA, 7834 bp, Homo sapiens
  CDS (373)..(7404): coding sequence for CAGNA1G alpha 1G subunit (isoform 3)
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacc

SEQ ID NO: 265 - protein, 2343 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 266 - DNA, 7690 bp, Homo sapiens
  CDS (373)..(7371): coding sequence for CAGNA1G alpha 1G subunit (isoform 4)
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctag

SEQ ID NO: 267 - protein, 2332 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 268 - DNA, 7657 bp, Homo sapiens
  CDS (373)..(7338): coding sequence for CAGNA1G alpha 1G subunit (isoform 5)
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctag

SEQ ID NO: 269 - protein, 2321 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 270 - DNA, 7612 bp, Homo sapiens
  CDS (373)..(7293): coding sequence for CAGNA1G alpha 1G subunit (isoform 6)
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctag

SEQ ID NO: 271 - protein, 2306 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 272 - DNA, 7588 bp, Homo sapiens
  CDS (373)..(7269): coding sequence for CAGNA1G alpha 1G subunit (isoform 7)
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctag

SEQ ID NO: 273 - protein, 2298 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 274 - DNA, 7546 bp, Homo sapiens
  CDS (373)..(7227): coding sequence for CAGNA1G alpha 1G subunit (isoform 8)
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctag

SEQ ID NO: 275 - protein, 2284 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 276 - DNA, 7513 bp, Homo sapiens
  CDS (373)..(7194): coding sequence for CACNA1G alpha 1G subunit (isoform 9)
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctag

SEQ ID NO: 277 - protein, 2273 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 278 - DNA, 7492 bp, Homo sapiens
  CDS (373)..(7173): coding sequence  for CACNA1G alpha 1G subunit (isoform 10)
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctag

SEQ ID NO: 279 - protein, 2266 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 280 - DNA, 7477 bp, Homo sapiens
  CDS (373)..(7158): coding sequence for CACNA1G alpha 1G subunit (isoform 11)
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctag

SEQ ID NO: 281 - protein, 2261 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 282 - DNA, 7471 bp, Homo sapiens
  CDS (373)..(7125): coding sequence for CACNA1G alpha 1G subunit (isoform 12)
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagaaaaaaaaaaaaaaaaaaaaaaaaaaa

SEQ ID NO: 283 - protein, 2250 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 284 - DNA, 7450 bp, Homo sapiens
  CDS (373)..(7104): coding sequence for CACNA1G alpha 1G subunit (isoform 13)
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagaaaaaaaaaaaaaaaaaaaaaaaaaaa

SEQ ID NO: 285 - protein, 2243 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 286 - DNA, 7207 bp, Homo sapiens
  CDS (373)..(6888): coding sequence for CACNA1G alpha 1G subunit (isoform 14)
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctag

SEQ ID NO: 287 - protein, 2171 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 288 - DNA, 5243 bp, Homo sapiens
  CDS (373)..(5040): coding sequence for CACNA1G alpha 1G subunit (isoform 15)
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggtgagccccaggctcagaggtggggctgtggtgaaggaggctggagggggcacagggccatgcttagtgatacctgctgactccggtggaggtgggctccacgaagagatcagcccttcacaccctctgctgtctaaccaccagcatgtcgcaaagcccagtccatcccacagtgccccaaaaagtgggcccatggggtctctagccgtccttaaagatgaagaaacagaggctcagagagggtaaggggcttgcccagggccacagagctacatggtggagcaggaagcacacgtggcagtgggggcaggcagccctggatgtgaatcctgtgcaaatcctgaccccaccattgtcagctcagtgacctggagcagctgacttaccagggcctcagtttcattaactggtgaatggagtcataatagaatctcctcggaggtcacaat

SEQ ID NO: 289 - protein, 1555 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQVSPRLRGGAVVKEAGGGTGPCLVIPADSGGGGLHEEISPSHPLLSNHQHVAKPSPSHSAPKSGPMGSLAVLKDEETEAQRG

SEQ ID NO: 290 - DNA, 792 bp, Homo sapiens
  CDS (52)..(477)
ccgccgctgccaccgcctctgatccaagccacctcccgccagagaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcaggactatgtgcagatgaaggccagtgagctggagcaggagcaagagagagagggctccagcctggacagccccagatctaagcggtgcggtaatctgagtacttgcatgctgggcacatacacgcaggacttcaacaagtttcacacgttcccccaaactgcaattggggttggagcacctggaaagaaaagggatatgtccagcgacttggagagagaccatcgccctcatgttagcatgccccagaatgccaactaaactcctccctttccttcctaatttcccttcttgcatccttcctataacttgatgcatgtggtttggttcctctctggtggctctttgggctggtattggtggctttccttgtggcagaggatgtctcaaacttcagatgggaggaaagagagcaggactcacaggttggaagagaatcacctgggaaaataccagaaaatgagggccgctttgagtcccccagagatgtcatcagagctcctctgtcctgcttctgaatgtgctgatcatttgaggaataaaattatttttccccaaaaaaaaaaaaaaaaaaaa

SEQ ID NO: 291 - protein, 141 aa, Homo sapiens
MGFQKFSPFLALSILVLLQAGSLHAAPFRSALESSPADPATLSEDEARLLLAALVQDYVQMKASELEQEQEREGSSLDSPRSKRCGNLSTCMLGTYTQDFNKFHTFPQTAIGVGAPGKKRDMSSDLERDHRPHVSMPQNAN

SEQ ID NO: 292 - DNA, 816 bp, Homo sapiens
  CDS (76)..(501)
ccgccgctgccaccgcctctgatccaagccacctcccgccaggtgagccccgagattctggctcagagaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcaggactatgtgcagatgaaggccagtgagctggagcaggagcaagagagagagggctccagcctggacagccccagatctaagcggtgcggtaatctgagtacttgcatgctgggcacatacacgcaggacttcaacaagtttcacacgttcccccaaactgcaattggggttggagcacctggaaagaaaagggatatgtccagcgacttggagagagaccatcgccctcatgttagcatgccccagaatgccaactaaactcctccctttccttcctaatttcccttcttgcatccttcctataacttgatgcatgtggtttggttcctctctggtggctctttgggctggtattggtggctttccttgtggcagaggatgtctcaaacttcagatgggaggaaagagagcaggactcacaggttggaagagaatcacctgggaaaataccagaaaatgagggccgctttgagtcccccagagatgtcatcagagctcctctgtcctgcttctgaatgtgctgatcatttgaggaataaaattatttttccccaaaaaaaaaaaaaaaaaaaa

SEQ ID NO: 293 - protein, 141 aa, Homo sapiens; identical to SEQ ID NO: 291

SEQ ID NO: 294 - DNA, 915 bp, Homo sapiens
  CDS (76)..(462)
ccgccgctgccaccgcctctgatccaagccacctcccgccaggtgagccccgagattctggctcagagaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcaggactatgtgcagatgaaggccagtgagctggagcaggagcaagagagagagggctccagaatcattgcccagaagagagcctgtgacactgccacctgtgtgactcatcggctggcaggcttgctgagcagatcagggggtgtggtgaagaacaactttgtgcccaccaatgtgggttccaaagcctttggcaggcgccgcagggaccttcaagcctgagcagctgaatgactcaagaaggtcacaataaagctgaactccttttaatgtgtaatgaaagcaatttgtaggaaaggctccatggaagacatacatataggcatccttcttgatactgaaaactatcttctttgtttgaaaggaactattgctaaatgcagaacaagctcattgcagttacctattgtgcatctttttaaatacttgattatgtaaccataaatctgacagcatgtctcattggcttatctggtagcaaatctaggccccgtcagccaccctattgacattggtggctctgctaaacctcagggggacatgaaatcactgcctcttgggcatctggggacacatggtaatgctgtgccttgacagaagtatttgtttaaagaaatgtcaatgctgtcatttgtgaactctatcaaaattaaaaatgtattttctatacccttc

SEQ ID NO: 295 - protein, 128 aa, Homo sapiens
MGFQKFSPFLALSILVLLQAGSLHAAPFRSALESSPADPATLSEDEARLLLAALVQDYVQMKASELEQEQEREGSRIIAQKRACDTATCVTHRLAGLLSRSGGVVKNNFVPTNVGSKAFGRRRRDLQA

SEQ ID NO: 296 - DNA, 735 bp, Homo sapiens
  CDS (75)..(488)
gagtctgcccttgcgagctcagagtgtgcccgtgcgccgccgccgtcgtacctgccgccgccgccaccgccaccatgcccaacttcgccggcacctggaagatgcgcagcagcgagaatttcgacgagctgctgaaggcactgggtgtgaacgccatgctgaggaaagtggccgtagcggctgcgtccaagccgcacgtggagatccgccaggacggggatcagttctacatcaagacatccaccaccgtgcgcaccactgagatcaacttcaaggtcggagaaggctttgaggaggagaccgtggacggacgcaagtgcaggagtttagccacttgggagaatgagaacaagatccactgcacccaaactcttcttgaaggggacggccccaaaacctactggacccgtgagctggccaacgatgaacttatcctgacgtttggcgccgatgacgtggtctgcaccagaatttatgtccgggaatgaaggcagctggcttgctcctactttcaggaagggatgcaggtccccgaggaatatgtcatagttctgagctgccagtggaccgcccttttcccctaccaatattaggtgatcccgttttccccatgacaatgttgtagtgtcccccacccccacccccctggccttggtgcctcttgtatccctagtgctgcatagcccggcatttgcacggtttcgaagtcattaaactggttagacgtgtctcaaa

SEQ ID NO: 297 - protein, 137 aa, Homo sapiens
MPNFAGTWKMRSSENFDELLKALGVNAMLRKVAVAAASKPHVEIRQDGDQFYIKTSTTVRTTEINFKVGEGFEEETVDGRKCRSLATWENENKIHCTQTLLEGDGPKTYWTRELANDELILTFGADDVVCTRIYVRE

SEQ ID NO: 298 - DNA, 5632 bp, Homo sapiens
  CDS (22)..(5289)
gttagcggcgtctcggttgccatggagaccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccggcgtcttccgcaacttgtactcagccgaggtcatcggcgacgaagtgagcgcaagcttgatcaaggcccgcggcagcgagaatgagcgccacgaggagttcgtggaccagctgcagcagattcgggagctctataagcagcggctggatgagtttgaaatgttggagagacatatcactcaggcccaagcacgggctattgcggaaaatgagcgggtcatgagccaggctggagtacaggacctcgagagccttgtcaggttgcctccagtgaagagtgtctccagatggtgtatagacagcgagttgctacggaaacatcatttgatctccccagaagattactacaccgatacagtgccgtttcactctgcacctaaaggcatctccctacctggatgttcaaaactgacatttagctgtgagaagcgttccgtccagaagaaagagctgaacaagaagcttgaagattcatgcaggaagaagcttgctgagttcgaagatgagttagaccacactgtggacagcctgacatggaatttaactcctaaggccaaagaaaggaccagagaacctctcaagaaagcaagtcaaccaaggaataaaaactggatgaaccacttacgtgtgccacagagagagctagacagacttctgcttgccagaatggagagtcggaaccacttcctaaaaaatccccgtttttttcctcctaacactcgatatggaggcaagtctcttgtttttcctccaaagaagccagcaccgataggagaattccagagtacagagccagaacagagttgtgctgatactccagtgtttctagctaagccaccaattgggtttttcacagattatgaaattggtccagtttatgagatggtaattgcgctgcagaacaccaccacgaccagccgctacctgcgagtcctcccgccttccacgccatacttcgctctgggactggggatgttcccaggaaaaggtggaatggtggctcctggaatgacctgccagtacattgtccagttttttcccgactgccttggggattttgatgattttattttagtggagacccagtcagcccacacacttctgatccccctgcaggcccggaggccgccccccgtgctgacattgtcaccggtgttggactgtggttactgcctcattgggggagtcaagatgaccagattcatctgcaaaaatgtgggtttcagtgttggcaggttctgcattatgcccaaaacaagctggccaccactaagtttcaaggccattgcaaccgtcggctttgttgaacaacctccttttggaatcctgccttcggtgtttgagctggccccgggacatgctatattagtggaggtcttgttttccccaaagagcctaggaaaggcagagcagaccttcatcatcatgtgcgacaactgccagataaaggagctggtgaccataggaattgggcagctgattgctttggatctgatctatatttctggtgaaaaaagccagccagaccctggagagctcacagacttaacagcccagcacttcatacgatttgagcctgaaaaccttcggtccacggctaggaagcagctgattattagaaatgctacgcacgtggagctggccttctactggcagatcatgaagcccaacctgcagcccctcatgcctggagaaaccttcagcatggacagcatcaagtgctaccccgacaaggagactgccttctccatcatgcccagaaagggggttctaagcccccacacagaccacgagttcatcctgagcttttctcctcatgagctgagggattttcacagtgtgctccagatggtgctagaggaagtcccagagcctgtaagttcagaagcggagagcctggggcactcctcctactctgtggatgatgtgattgtcctggaaatcgaggtgaaaggctcagtagaacctttccaggttctcttagagccatatgccctcatcatcccaggggagaactacattgggataaatgtgaagaaggcttttaagatgtggaacaacagcaagtcacccatcagatacctgtgggggaagatcagcgactgccacatcattgaagtggagcccggcacaggggtcatagagcccagtgaggtcggggattttgagttgaactttactgggggtgtccctggccccacaagccaggacctgctgtgtgaaatcgaagactcgccctcgccagtggtgttacacattgaggctgtctttaaggggcctgccctcatcatcaacgtctcagcccttcagtttggtctgctccgcctggggcagaaagccacaaactccatccagatccggaacgtcagccagctcccagccacatggcgcatgaaggagagcccagtctccctccaggaaaggcctgaggatgtgtctcccttcgacattgagccttcgagtggccagcttcactctctgggggagtgcagggtggacatcaccttggaggccctgcactgccagcatctggagaccgtcctggagctggaggtggaaaatggtgcctggagctaccttcctgtgtatgctgaggtacagaagccccatgtgtacctacagagcagccaggtggaggttagaaatctctacctgggtgtgcccacgaagacaaccatcacacttatcaatggcacgctcctgcctacccagttccactggggcaagctcctcggacaccaagcagaattctgcatggtgacagtctcccccaaacatggcctgctgggcccaagtgaggagtgccagctcaagttggagttgactgctcatacccaggaagagctgacccatctggccctcccttgtcacgtgtcaggcatgaagaagccactggttctaggcatttctgggaagccccagggactgcaagtggccattaccatctctaaggagagctctgattgcagcacagagcagtggccaggccacccaaaggagctccgcctggactttggctcagcggtgccactgaggacccgtgtgactcgccagctcattctcaccaatcgctccccaatacggacccgtttctccctcaagtttgagtatttcgggagcccccaaaacagcctgagcaaaaagaccagccttcccaacatgcctcctgccctgctaaagacagtgcggatgcaagagcacctggccaagcgagagcagctggattttatggagagcatgctatcccacgggaaaggagctgctttcttccctcacttttcccagggcatgctggggccctaccagcagctgtgcattgacatcacaggctgtgccaacatgtggggcgagtactgggacaacctcatctgcacggtgggagacctgctgccggaagtcatcccagtgcacatggcagcggtgggctgccccatcagctccctgaggaccacctcctacactattgaccaggcccagaaggaaccagccatgaggttcggcacccaggtctccggaggagacacagttacccgaacccttcgcctgaataactccagcccctgtgacatccgcctggattgggagacctatgttccagaagacaaggaagaccggctggtggagctgctggtgttttatgggccacctttcccgctgcgggaccaagccgggaatgagcttgtgtgccctgatacccctgagggtggctgcctcctctggtccccaggcccctccagttcatcggaattcagccatgaaactgactcatcagttgagggcagctccagtgccagcaatagggtggcacagaagctcatctcagtcatcctgcaggcacatgagggggtgccctccggccacctgtactgtatcagccccaagcaggtggtggtccctgctgggggcagcagtaccatctacatctccttcacccctatggtgctcagccctgagatcctgcacaaggtggagtgtactggctacgccctgggtttcatgagcttggacagcaaggtggaaagggagattccagggaagaggcatcgcctgcaggactttgcggtgggacccctgaaactggacctgcatagctacgtgaggcctgcacagctaagtgtggagctggactacggcggcagtatggaattccagtgccaggccagtgacctcattcccgagcagccctgctctggggtgctgagtgagctggtgaccacccaccacctgaagctgaccaacactacagagatcccacactacttccggcttatggtctccaggcccttctccgtttctcaagatggggcgagccaggaccacagagctcctggccctggccagaagcaggagtgtgaggaggagacagcctcagcggacaagcagctggtgctccaagcacaggagaacatgctggtgaacgtgtccttctcactctccctggagctgctctcctatcagaagctcccagctgaccagacactgcctggggtggacattcagcagagtgcgagtggagagagagagatggtgtttactcagaacctgctcctggagtacaccaaccagaccactcaggtggtgcccctgcgggctgtggtggccgtgcctgagctgcagctctccaccagctgggtggactttgggacctgctttgtgagccagcagcgagtccgggaggtctacctgatgaacctgagcgggtgccgaagctactggactatgctgatgggccagcaggagccagccaaggccgctgtggccttcagggtctccccaaacagtgggctgctagaagcacgatccgccaatgcacccccaacctccatcgccttgcaggttttcttcactgccaggagtagtgagctgtacgagtccacgatggtggtggaaggtgtgctcggtgagaagtcctgcaccctgcggctccggggccaaggctcctatgatgagagatacatgttgcctcaccagccctgaggctccgccccagccctcagccccaggccccagctggagaaaaaacattgcccagggattaggagcagctcttcagcacaaagacacagacttggggacctggggacctctgggcagctcctggaatggaagaacccccttccacaatggtctcagcctaggccctcatgatatgtcctcagagctaacataaaggacaggccacaccacagcagagaccaccacattgagatcactactcagtgcatagcgaagaccagtatggcaaaattagtcttggaaaaaaaccacagccactaagataaattcatgcacttttactatgaaaaaaaaaaaaaaaaaa

SEQ ID NO: 299 - protein, 1755 aa, Homo sapiens
METRSSKTRRSLASRTNECQGTMWAPTSPPAGSSSPSQPTWKSSLYSSLAYSEAFHYSFAARPRRLTQLALAQRPEPQLLRLRPSSLRTQDISHLLTGVFRNLYSAEVIGDEVSASLIKARGSENERHEEFVDQLQQIRELYKQRLDEFEMLERHITQAQARAIAENERVMSQAGVQDLESLVRLPPVKSVSRWCIDSELLRKHHLISPEDYYTDTVPFHSAPKGISLPGCSKLTFSCEKRSVQKKELNKKLEDSCRKKLAEFEDELDHTVDSLTWNLTPKAKERTREPLKKASQPRNKNWMNHLRVPQRELDRLLLARMESRNHFLKNPRFFPPNTRYGGKSLVFPPKKPAPIGEFQSTEPEQSCADTPVFLAKPPIGFFTDYEIGPVYEMVIALQNTTTTSRYLRVLPPSTPYFALGLGMFPGKGGMVAPGMTCQYIVQFFPDCLGDFDDFILVETQSAHTLLIPLQARRPPPVLTLSPVLDCGYCLIGGVKMTRFICKNVGFSVGRFCIMPKTSWPPLSFKAIATVGFVEQPPFGILPSVFELAPGHAILVEVLFSPKSLGKAEQTFIIMCDNCQIKELVTIGIGQLIALDLIYISGEKSQPDPGELTDLTAQHFIRFEPENLRSTARKQLIIRNATHVELAFYWQIMKPNLQPLMPGETFSMDSIKCYPDKETAFSIMPRKGVLSPHTDHEFILSFSPHELRDFHSVLQMVLEEVPEPVSSEAESLGHSSYSVDDVIVLEIEVKGSVEPFQVLLEPYALIIPGENYIGINVKKAFKMWNNSKSPIRYLWGKISDCHIIEVEPGTGVIEPSEVGDFELNFTGGVPGPTSQDLLCEIEDSPSPVVLHIEAVFKGPALIINVSALQFGLLRLGQKATNSIQIRNVSQLPATWRMKESPVSLQERPEDVSPFDIEPSSGQLHSLGECRVDITLEALHCQHLETVLELEVENGAWSYLPVYAEVQKPHVYLQSSQVEVRNLYLGVPTKTTITLINGTLLPTQFHWGKLLGHQAEFCMVTVSPKHGLLGPSEECQLKLELTAHTQEELTHLALPCHVSGMKKPLVLGISGKPQGLQVAITISKESSDCSTEQWPGHPKELRLDFGSAVPLRTRVTRQLILTNRSPIRTRFSLKFEYFGSPQNSLSKKTSLPNMPPALLKTVRMQEHLAKREQLDFMESMLSHGKGAAFFPHFSQGMLGPYQQLCIDITGCANMWGEYWDNLICTVGDLLPEVIPVHMAAVGCPISSLRTTSYTIDQAQKEPAMRFGTQVSGGDTVTRTLRLNNSSPCDIRLDWETYVPEDKEDRLVELLVFYGPPFPLRDQAGNELVCPDTPEGGCLLWSPGPSSSSEFSHETDSSVEGSSSASNRVAQKLISVILQAHEGVPSGHLYCISPKQVVVPAGGSSTIYISFTPMVLSPEILHKVECTGYALGFMSLDSKVEREIPGKRHRLQDFAVGPLKLDLHSYVRPAQLSVELDYGGSMEFQCQASDLIPEQPCSGVLSELVTTHHLKLTNTTEIPHYFRLMVSRPFSVSQDGASQDHRAPGPGQKQECEEETASADKQLVLQAQENMLVNVSFSLSLELLSYQKLPADQTLPGVDIQQSASGEREMVFTQNLLLEYTNQTTQVVPLRAVVAVPELQLSTSWVDFGTCFVSQQRVREVYLMNLSGCRSYWTMLMGQQEPAKAAVAFRVSPNSGLLEARSANAPPTSIALQVFFTARSSELYESTMVVEGVLGEKSCTLRLRGQGSYDERYMLPHQP

SEQ ID NO: 300 - DNA, 3070 bp, Homo sapiens
  CDS (558)..(1889)
ggcgccgtcttgatactttcagaaagaatgcattccctgtaaaaaaaaaaaaaaaatactgagagagggagagagagagagaagaagagagagagacggagggagagcgagacagagcgagcaacgcaatctgaccgagcaggtcgtacgccgccgcctcctcctcctctctgctcttcgctacccaggtgacccgaggagggactccgcctccgagcggctgaggaccccggtgcagaggagcctggctcgcagaattgcagagtcgtcgcccctttttacaacctggtcccgttttattctgccgtacccagtttttggatttttgtcttccccttcttctctttgctaaacgacccctccaagataatttttaaaaaaccttctcctttgctcacctttgcttcccagccttcccatccccccaccgaaagcaaatcattcaacgacccccgaccctccgacggcaggagccccccgacctcccaggcggaccgccctccctccccgcgcgcgggttccgggcccggcgagagggcgcgagcacagccgaggccatggaggtgacggcggaccagccgcgctgggtgagccaccaccaccccgccgtgctcaacgggcagcacccggacacgcaccacccgggcctcagccactcctacatggacgcggcgcagtacccgctgccggaggaggtggatgtgctttttaacatcgacggtcaaggcaaccacgtcccgccctactacggaaactcggtcagggccacggtgcagaggtaccctccgacccaccacgggagccaggtgtgccgcccgcctctgcttcatggatccctaccctggctggacggcggcaaagccctgggcagccaccacaccgcctccccctggaatctcagccccttctccaagacgtccatccaccacggctccccggggcccctctccgtctaccccccggcctcgtcctcctccttgtcggggggccacgccagcccgcacctcttcaccttcccgcccaccccgccgaaggacgtctccccggacccatcgctgtccaccccaggctcggccggctcggcccggcaggacgagaaagagtgcctcaagtaccaggtgcccctgcccgacagcatgaagctggagtcgtcccactcccgtggcagcatgaccgccctgggtggagcctcctcgtcgacccaccaccccatcaccacctacccgccctacgtgcccgagtacagctccggactcttcccccccagcagcctgctgggcggctcccccaccggcttcggatgcaagtccaggcccaaggcccggtccagcacagaaggcagggagtgtgtgaactgtggggcaacctcgaccccactgtggcggcgagatggcacgggacactacctgtgcaacgcctgcgggctctatcacaaaatgaacggacagaaccggcccctcattaagcccaagcgaaggctgtctgcagccaggagagcagggacgtcctgtgcgaactgtcagaccaccacaaccacactctggaggaggaatgccaatggggaccctgtctgcaatgcctgtgggctctactacaagcttcacaatattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcctttggaccacaccacccctccagcatggtcaccgccatgggttagagccctgctcgatgctcacagggcccccagcgagagtccctgcagtccctttcgacttgcatttttgcaggagcagtatcatgaagcctaaacgcgatggatatatgtttttgaaggcagaaagcaaaattatgtttgccactttgcaaaggagctcactgtggtgtctgtgttccaaccactgaatctggaccccatctgtgaataagccattctgactcatatcccctatttaacagggtctctagtgctgtgaaaaaaaaaatgctgaacattgcatataacttatattgtaagaaatactgtacaatgactttattgcatctgggtagctgtaaggcatgaaggatgccaagaagtttaaggaatatgggagaaatagtgtggaaattaagaagaaactaggtctgatattcaaatggacaaactgccagttttgtttcctttcactggccacagttgtttgatgcattaaaagaaaataaaaaaaagaaaaaagagaaaagaaaaaaaaagaaaaaagttgtaggcgaatcatttgttcaaagctgttggcctctgcaaaggaaataccagttctgggcaatcagtgttaccgttcaccagttgccgttgagggtttcagagagcctttttctaggcctacatgctttgtgaacaagtccctgtaattgttgtttgtatgtataattcaaagcaccaaaataagaaaagatgtagatttatttcatcatattatacagaccgaactgttgtataaatttatttactgctagtcttaagaactgctttctttcgtttgtttgtttcaatattttccttctctctcaatttttggttgaataaactagattacattcagttggcctaaggtggttgtgctcggagggtttcttgtttcttttccattttgtttttggatgatatttattaaatagcttctaagagtccggcggcatctgtcttgtccctattcctgcagcctgtgctgagggtagcagtgtatgagctaccagcgtgcatgtcagcgaccctggcccgacaggccacgtcctgcaatcggcccggctgcctcttcgccctgtcgtgttctgtgttagtgatcactgcctttaatacagtctgttggaataatattataagcataataataaagtgaaaatattttaaaactacaa

SEQ ID NO: 301 - protein, 444 aa, Homo sapiens
MEVTADQPRWVSHHHPAVLNGQHPDTHHPGLSHSYMDAAQYPLPEEVDVLFNIDGQGNHVPPYYGNSVRATVQRYPPTHHGSQVCRPPLLHGSLPWLDGGKALGSHHTASPWNLSPFSKTSIHHGSPGPLSVYPPASSSSLSGGHASPHLFTFPPTPPKDVSPDPSLSTPGSAGSARQDEKECLKYQVPLPDSMKLESSHSRGSMTALGGASSSTHHPITTYPPYVPEYSSGLFPPSSLLGGSPTGFGCKSRPKARSSTEGRECVNCGATSTPLWRRDGTGHYLCNACGLYHKMNGQNRPLIKPKRRLSAARRAGTSCANCQTTTTTLWRRNANGDPVCNACGLYYKLHNINRPLTMKKEGIQTRNRKMSSKSKKCKKVHDSLEDFPKNSSFNPAALSRHMSSLSHISPFSHSSHMLTTPTPMHPPSSLSFGPHHPSSMVTAMG

SEQ ID NO: 302 - DNA, 3067 bp, Homo sapiens
  CDS (558)..(1889)
ggcgccgtcttgatactttcagaaagaatgcattccctgtaaaaaaaaaaaaaaaatactgagagagggagagagagagagaagaagagagagagacggagggagagcgagacagagcgagcaacgcaatctgaccgagcaggtcgtacgccgccgcctcctcctcctctctgctcttcgctacccaggtgacccgaggagggactccgcctccgagcggctgaggaccccggtgcagaggagcctggctcgcagaattgcagagtcgtcgcccctttttacaacctggtcccgttttattctgccgtacccagtttttggatttttgtcttccccttcttctctttgctaaacgacccctccaagataatttttaaaaaaccttctcctttgctcacctttgcttcccagccttcccatccccccaccgaaagcaaatcattcaacgacccccgaccctccgacggcaggagccccccgacctcccaggcggaccgccctccctccccgcgcgcgggttccgggcccggcgagagggcgcgagcacagccgaggccatggaggtgacggcggaccagccgcgctgggtgagccaccaccaccccgccgtgctcaacgggcagcacccggacacgcaccacccgggcctcagccactcctacatggacgcggcgcagtacccgctgccggaggaggtggatgtgctttttaacatcgacggtcaaggcaaccacgtcccgccctactacggaaactcggtcagggccacggtgcagaggtaccctccgacccaccacgggagccaggtgtgccgcccgcctctgcttcatggatccctaccctggctggacggcggcaaagccctgggcagccaccacaccgcctccccctggaatctcagccccttctccaagacgtccatccaccacggctccccggggcccctctccgtctaccccccggcctcgtcctcctccttgtcggggggccacgccagcccgcacctcttcaccttcccgcccaccccgccgaaggacgtctccccggacccatcgctgtccaccccaggctcggccggctcggcccggcaggacgagaaagagtgcctcaagtaccaggtgcccctgcccgacagcatgaagctggagtcgtcccactcccgtggcagcatgaccgccctgggtggagcctcctcgtcgacccaccaccccatcaccacctacccgccctacgtgcccgagtacagctccggactcttcccccccagcagcctgctgggcggctcccccaccggcttcggatgcaagtccaggcccaaggcccggtccagcacaggcagggagtgtgtgaactgtggggcaacctcgaccccactgtggcggcgagatggcacgggacactacctgtgcaacgcctgcgggctctatcacaaaatgaacggacagaaccggcccctcattaagcccaagcgaaggctgtctgcagccaggagagcagggacgtcctgtgcgaactgtcagaccaccacaaccacactctggaggaggaatgccaatggggaccctgtctgcaatgcctgtgggctctactacaagcttcacaatattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcctttggaccacaccacccctccagcatggtcaccgccatgggttagagccctgctcgatgctcacagggcccccagcgagagtccctgcagtccctttcgacttgcatttttgcaggagcagtatcatgaagcctaaacgcgatggatatatgtttttgaaggcagaaagcaaaattatgtttgccactttgcaaaggagctcactgtggtgtctgtgttccaaccactgaatctggaccccatctgtgaataagccattctgactcatatcccctatttaacagggtctctagtgctgtgaaaaaaaaaatgctgaacattgcatataacttatattgtaagaaatactgtacaatgactttattgcatctgggtagctgtaaggcatgaaggatgccaagaagtttaaggaatatgggagaaatagtgtggaaattaagaagaaactaggtctgatattcaaatggacaaactgccagttttgtttcctttcactggccacagttgtttgatgcattaaaagaaaataaaaaaaagaaaaaagagaaaagaaaaaaaaagaaaaaagttgtaggcgaatcatttgttcaaagctgttggcctctgcaaaggaaataccagttctgggcaatcagtgttaccgttcaccagttgccgttgagggtttcagagagcctttttctaggcctacatgctttgtgaacaagtccctgtaattgttgtttgtatgtataattcaaagcaccaaaataagaaaagatgtagatttatttcatcatattatacagaccgaactgttgtataaatttatttactgctagtcttaagaactgctttctttcgtttgtttgtttcaatattttccttctctctcaatttttggttgaataaactagattacattcagttggcctaaggtggttgtgctcggagggtttcttgtttcttttccattttgtttttggatgatatttattaaatagcttctaagagtccggcggcatctgtcttgtccctattcctgcagcctgtgctgagggtagcagtgtatgagctaccagcgtgcatgtcagcgaccctggcccgacaggccacgtcctgcaatcggcccggctgcctcttcgccctgtcgtgttctgtgttagtgatcactgcctttaatacagtctgttggaataatattataagcataataataaagtgaaaatattttaaaactacaa

SEQ ID NO: 303 - protein, 443 aa, Homo sapiens
MEVTADQPRWVSHHHPAVLNGQHPDTHHPGLSHSYMDAAQYPLPEEVDVLFNIDGQGNHVPPYYGNSVRATVQRYPPTHHGSQVCRPPLLHGSLPWLDGGKALGSHHTASPWNLSPFSKTSIHHGSPGPLSVYPPASSSSLSGGHASPHLFTFPPTPPKDVSPDPSLSTPGSAGSARQDEKECLKYQVPLPDSMKLESSHSRGSMTALGGASSSTHHPITTYPPYVPEYSSGLFPPSSLLGGSPTGFGCKSRPKARSSTGRECVNCGATSTPLWRRDGTGHYLCNACGLYHKMNGQNRPLIKPKRRLSAARRAGTSCANCQTTTTTLWRRNANGDPVCNACGLYYKLHNINRPLTMKKEGIQTRNRKMSSKSKKCKKVHDSLEDFPKNSSFNPAALSRHMSSLSHISPFSHSSHMLTTPTPMHPPSSLSFGPHHPSSMVTAMG

SEQ ID NO: 304 - DNA, 2561 bp, Homo sapiens
  CDS (95)..(1102)
attcatatcatttttcttctccggccccatggaggaagtgagaaagttggcacagtcacgccgggcttcgcaggaccaggtcactcagtgacagatggacaatgcaagaatgaactccttcctggaataccccatacttagcagtggcgactcggggacctgctcagcccgagcctacccctcggaccataggattacaactttccagtcgtgcgcggtcagcgccaacagttgcggcggcgacgaccgcttcctagtgggcaggggggtgcagatcggttcgccccaccaccaccaccaccaccaccatcaccacccccagccggctacctaccagacttccgggaacctgggggtgtcctactcccactcaagttgtggtccaagctatggctcacagaacttcagtgcgccttacagcccctacgcgttaaatcaggaagcagacgtaagtggtgggtacccccagtgcgctcccgctgtttactctggaaatctctcatctcccatggtccagcatcaccaccaccaccagggttatgctgggggcgcggtgggctcgcctcaatacattcaccactcatatggacaggagcaccagagcctggccctggctacgtataataactccttgtcccctctccacgccagccaccaagaagcctgtcgctcccccgcatcggagacatcttctccagcgcagacttttgactggatgaaagtcaaaagaaaccctcccaaaacagggaaagttggagagtacggctacctgggtcaacccaacgcggtgcgcaccaacttcactaccaagcagctcacggaactggagaaggagttccacttcaacaagtacctgacgcgcgcccgcagggtggagatcgctgcatccctgcagctcaacgagacccaagtgaagatctggttccagaaccgccgaatgaagcaaaagaaacgtgagaaggagggtctcttgcccatctctccggccaccccgccaggaaacgacgagaaggccgaggaatcctcagagaagtccagctcttcgccctgcgttccttccccggggtcttctacctcagacactctgactacctcccactgaggcggctccagccccagacaacagcccaggcatctccttgggctgggacttcttacccaaagcacatgcttagcttatctttctttccatttacagtctctttcttcctttctaatcctatctggggagctcctggccaggataatatatttgcagataattctggaccagagacttggtgcggggttaacaccttcatccagattgggtgccagcatacattttctggtgggccttaacatccctcctgcttttaggagaattcacagaacctactgttcctttcagatgaccttttggaaaatagttccctttgccaacagaaacatgccagaaggaatcttctcatcttttatctaactatatgtacagctctcccctcccttgtccttgaaagtaggatatagcgaaaggcgagtccaggagctcaggaagaagagatgcactatatgtttacacaattaattcatcccttaatttaagtcattttcatgtgtgtgagtttgctggttgtaaatactttgtcctaagagatttatctttatacagattttctagaaatgtttaggttactaaaacagggtgggcaaactctctaaactggtacaattttataggtgaaagaaaaaattccctcatttaaacccaatcagatgcctcagagggtagccttgatttgttcttacagttaagaagccctgcagagcacaaacttcagaaacccggcttcctgtgctaagtctttcccaatctctacccctttcttctcgggccaccctctgtttaaaatttgtgctgggttattcagaacctaaaagtattattcaaaccaatttcttccttccacagttatcttagctggatataatgtattttcagctcaattgttaatgtgatggatggcacaatgaatgtatattttgtgttattcgtgaatagtcttttgcatgtcgcacaatgtttgatgtccccaaagtaccacactgagttctatcagttatcctttgtgagcctatgatattccccatttcctgtacaatcatgaacagctctgagatcctggagtgatatgatccagagcagagtttacgggtcttaggatgtctgtaataaataaatatactcaagtttcaggtatgcttaagcatccgtgtatttggctgggctacaatttgttaattcctatgaagttggcacatttcatgaggggaaagggagaagggtggtaaatattttcaaagagatgggccttttcttgaataaaagttaataacagctcctttattataatcaaagctcataatggaaaaaaagactgatgaagaaatttatgaagcagatttatttttgaaacaaacatggatacttcctgggtcaagtgctaaccttttcacctccaactggatgttgacgtatatataaacagaactcccttcaaaagccaaaaaaaaaaaaaaaa

SEQ ID NO: 305 - protein, 335 aa, Homo sapiens
MDNARMNSFLEYPILSSGDSGTCSARAYPSDHRITTFQSCAVSANSCGGDDRFLVGRGVQIGSPHHHHHHHHHHPQPATYQTSGNLGVSYSHSSCGPSYGSQNFSAPYSPYALNQEADVSGGYPQCAPAVYSGNLSSPMVQHHHHHQGYAGGAVGSPQYIHHSYGQEHQSLALATYNNSLSPLHASHQEACRSPASETSSPAQTFDWMKVKRNPPKTGKVGEYGYLGQPNAVRTNFTTKQLTELEKEFHFNKYLTRARRVEIAASLQLNETQVKIWFQNRRMKQKKREKEGLLPISPATPPGNDEKAEESSEKSSSSPCVPSPGSSTSDTLTTSH

SEQ ID NO: 306 - DNA, 2358 bp, Homo sapiens
  CDS (95)..(508)
attcatatcatttttcttctccggccccatggaggaagtgagaaagttggcacagtcacgccgggcttcgcaggaccaggtcactcagtgacagatggacaatgcaagaatgaactccttcctggaataccccatacttagcagtggcgactcggggacctgctcagcccgagcctacccctcggaccataggattacaactttccagtcgtgcgcggtcagcgccaacagttgcggcggcgacgaccgcttcctagtgggcaggggggtgcagatcggttcgccccaccaccaccaccaccaccaccatcaccacccccagccggctacctaccagacttccgggaacctgggggtgtcctactcccactcaagttgtggtccaagctatggctcacagaacttcagtgcgccttacagcccctacgcgttaaatcaggaagcagacccaccaagaagcctgtcgctcccccgcatcggagacatcttctccagcgcagacttttgactggatgaaagtcaaaagaaaccctcccaaaacagggaaagttggagagtacggctacctgggtcaacccaacgcggtgcgcaccaacttcactaccaagcagctcacggaactggagaaggagttccacttcaacaagtacctgacgcgcgcccgcagggtggagatcgctgcatccctgcagctcaacgagacccaagtgaagatctggttccagaaccgccgaatgaagcaaaagaaacgtgagaaggagggtctcttgcccatctctccggccaccccgccaggaaacgacgagaaggccgaggaatcctcagagaagtccagctcttcgccctgcgttccttccccggggtcttctacctcagacactctgactacctcccactgaggcggctccagccccagacaacagcccaggcatctccttgggctgggacttcttacccaaagcacatgcttagcttatctttctttccatttacagtctctttcttcctttctaatcctatctggggagctcctggccaggataatatatttgcagataattctggaccagagacttggtgcggggttaacaccttcatccagattgggtgccagcatacattttctggtgggccttaacatccctcctgcttttaggagaattcacagaacctactgttcctttcagatgaccttttggaaaatagttccctttgccaacagaaacatgccagaaggaatcttctcatcttttatctaactatatgtacagctctcccctcccttgtccttgaaagtaggatatagcgaaaggcgagtccaggagctcaggaagaagagatgcactatatgtttacacaattaattcatcccttaatttaagtcattttcatgtgtgtgagtttgctggttgtaaatactttgtcctaagagatttatctttatacagattttctagaaatgtttaggttactaaaacagggtgggcaaactctctaaactggtacaattttataggtgaaagaaaaaattccctcatttaaacccaatcagatgcctcagagggtagccttgatttgttcttacagttaagaagccctgcagagcacaaacttcagaaacccggcttcctgtgctaagtctttcccaatctctacccctttcttctcgggccaccctctgtttaaaatttgtgctgggttattcagaacctaaaagtattattcaaaccaatttcttccttccacagttatcttagctggatataatgtattttcagctcaattgttaatgtgatggatggcacaatgaatgtatattttgtgttattcgtgaatagtcttttgcatgtcgcacaatgtttgatgtccccaaagtaccacactgagttctatcagttatcctttgtgagcctatgatattccccatttcctgtacaatcatgaacagctctgagatcctggagtgatatgatccagagcagagtttacgggtcttaggatgtctgtaataaataaatatactcaagtttcaggtatgcttaagcatccgtgtatttggctgggctacaatttgttaattcctatgaagttggcacatttcatgaggggaaagggagaagggtggtaaatattttcaaagagatgggccttttcttgaataaaagttaataacagctcctttattataatcaaagctcataatggaaaaaaagactgatgaagaaatttatgaagcagatttatttttgaaacaaacatggatacttcctgggtcaagtgctaaccttttcacctccaactggatgttgacgtatatataaacagaactcccttcaaaagccaaaaaaaaaaaaaaaa

SEQ ID NO: 307 - protein, 137 aa, Homo sapiens
MDNARMNSFLEYPILSSGDSGTCSARAYPSDHRITTFQSCAVSANSCGGDDRFLVGRGVQIGSPHHHHHHHHHHPQPATYQTSGNLGVSYSHSSCGPSYGSQNFSAPYSPYALNQEADPPRSLSLPRIGDIFSSADF

SEQ ID NO: 308 - DNA, 1356 bp, Homo sapiens
  CDS (553)..(1095): human IGF2 coding sequence
ttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctcccccc

SEQ ID NO: 309 - protein, 180 aa, Homo sapiens
MGIPMGKSMLVLLTFLAFASCCIAAYRPSETLCGGELVDTLQFVCGDRGFYFSRPASRVSRRSRGIVEECCFRSCDLALLETYCATPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 310 - DNA, 5003 bp, Homo sapiens
  CDS (9)..(3047)
cgcgcagcatgcccgccagcgccccgccgcgccgcccgcggccgccgccgccgtcgctgtcgctgctgctggtgctgctgggcctgggcggccgccgcctgcgtgcggagccgggcgacggcgcgcagacctgggcccgtttctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggatacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtagataccactctgtctcagtttaccgacctgaatgtttacctgtgggatgtccaccacagtaaaaggcttattaaagtggatggggttgtgaccaagaagaggaaatcctactgtgttgactttgctgccatccagccccagatcgctttactccaggaaatgcacgttacacattttcgcttctccctggactgggccctgattctccctctgggtaaccagtcccaggtgaaccacaccatcctgcagtactatcgctgcatggccagcgagcttgtccgtgtcaacatcaccccagtggtggccctgtggcagcctatggccccgaaccaaggactgccgcgcctcctggccaggcagggcgcctgggagaacccctacactgccctggcctttgcagagtatgcccgactgtgctttcaagagctcggccatcacgtcaagctttggataacgatgaatgagccgtatacaaggaatatgacatacagtgctggccacaaccttctgaaggcccatgccctggcttggcatgtgtacaatgaaaagtttaggcatgctcagaatgggaaaatatccatagccttgcaggctgattggatagaacctgcctgccctttctcccaaaaggacaaagaggtggccgagagagttttggaatttgacattggctggctggctgagcccattttcggctctggagattatccatgggtgatgagggactggctgaaccaaagaaacaattttcttcttccttatttcactgaagatgaaaaaaagctaatccagggtacctttgactttttggctttaagccattataccaccatccttgtagactcagaaaaagaagatccaataaaatacaatgattacctagaagtgcaagaaatgaccgacatcacgtggctcaactcccccagtcaggtggcggtagtgccctgggggttgcgcaaagtgctgaactggctgaagttcaagtacggagacctccccatgtacataatatccaacggaatcgatgacgggctgcatgctgaggacgaccagctgagggtgtattatatgcagaattacataaacgaagctctcaaagcccacatactggatggtatcaatctttgcggatactttgcttattcgtttaacgaccgcacagctccgaggtttggcctctatcgttatgctgcagatcagtttgagcccaaggcatccatgaaacattacaggaaaattattgacagcaatggtttcccgggcccagaaactctggaaagattttgtccagaagaattcaccgtgtgtactgagtgcagtttttttcacacccgaaagtctttactggctttcatagcttttctattttttgcttctattatttctctctcccttatattttactactcgaagaaaggcagaagaagttacaaatagttctgaacatttttctattcattcattttgaaataattatgcagacacatcagctgttaaccatttgcacctctaagtgttgtgaaactgtaaatttcatacatttgacttctagaaaacatttttgtggcttatgacagaggttttgaaatgggcataggtgatcgtaaaatattgaataatgcgaatagtgcctgaatttgttctctttttgggtgattaaaaaactgacaggcactataatttctgtaacacactaacaaaagcatgaaaaataggaaccacaccaatgcaacatttgtgcagaaatttgaatgacaagattaggaatattttcttctgcacccacttctaaatttaatgtttttctggaagtagtaattgcaagagttcgaatagaaagttatgtaccaagtaaccatttctcagctgccataataatgcctagtggcttcccctctgtcaaatctagtttcctatggaaaagaagatggcagatacaggagagacgacagagggtcctaggctggaatgttcctttcgaaagcaatgcttctatcaaatactagtattaatttatgtatctggttaatgacatacttggagagcaaattatggaaatgtgtattttatatgatttttgaggtcctgtctaaaccctgtgtccctgagggatctgtctcactggcatcttgttgagggccttgcacataggaaacttttgataagtatctgcggaaaaacaaacatgaatcctgtgatattgggctcttcaggaagcataaagcaattgtgaaatacagtataccgcagtggctctaggtggaggaaaggaggaaaaagtgcttattatgtgcaacattatgattaatctgattatacaccatttttgagcagatcttggaatgaatgacatgacctttccctagagaataaggatgaaataatcactcattctatgaacagtgacactactttctattctttagctgtactgtaatttctttgagttgatagttttacaaattcttaataggttcaaaagcaatctggtctgaataacactggatttgtttctgtgatctctgaggtctattttatgtttttgctgctacttctgtggaagtagctttgaactagttttactttgaactttcacgctgaaacatgctagtgatatctagaaagggctaattaggtctcatcctttaatgccccttaaataagtcttgctgattttcagacagggaagtctctctattacactggagctgttttatagataagtcaatattgtatcaggcaagataaaccaatgtcataacaggcattgccaacctcactgacacagggtcatagtgtataataatatactgtactatataatatatcatctttagaggtatgattttttcatgaaagataagcttttggtaatattcattttaaagtggacttattaaaattggatgctagagaatcaagtttattttatgtatatatttttctgattataagagtaatatatgttcattgtaaaaatttttaaaacacagaaactatatgcaaagaaaaaataaaaattatctataatctcagaacccagaaatagccactattaacatttcctacgtattttattttacatagatcatattgtatatagttagtatctttattaatttttattatgaaactttcctttgtcattattagtcttcaaaagcatgatttttaatagttgttgagtattccaccacaggaatgtatcacaacttaaccgttcccgtttgttagactagtttcttattaatgttgatgaatgttgtttaaaaataattttgttgctacatttactttaatttccttgactgtaaagagaagtaattttgctccttgataaagtattatattaataataaatctgcctgcaactttttgccttctttcataatc

SEQ ID NO: 311 - protein, 1012 aa, Homo sapiens
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSLLAFIAFLFFASIISLSLIFYYSKKGRRSYK

SEQ ID NO: 312 - DNA, 5049 bp, Homo sapiens
  CDS (9)..(1658)
cgcgcagcatgcccgccagcgccccgccgcgccgcccgcggccgccgccgccgtcgctgtcgctgctgctggtgctgctgggcctgggcggccgccgcctgcgtgcggagccgggcgacggcgcgcagacctgggcccgtttctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggacacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtaagtcagctgacaaaaccaatcagcagtctcaccaagccctatcactaataccactctgtctcagtttaccgacctgaatgtttacctgtgggatgtccaccacagtaaaaggcttattaaagtggatggggttgtgaccaagaagaggaaatcctactgtgttgactttgctgccatccagccccagatcgctttactccaggaaatgcacgttacacattttcgcttctccctggactgggccctgattctccctctgggtaaccagtcccaggtgaaccacaccatcctgcagtactatcgctgcatggccagcgagcttgtccgtgtcaacatcaccccagtggtggccctgtggcagcctatggccccgaaccaaggactgccgcgcctcctggccaggcagggcgcctgggagaacccctacactgccctggcctttgcagagtatgcccgactgtgctttcaagagctcggccatcacgtcaagctttggataacgatgaatgagccgtatacaaggaatatgacatacagtgctggccacaaccttctgaaggcccatgccctggcttggcatgtgtacaatgaaaagtttaggcatgctcagaatgggaaaatatccatagccttgcaggctgattggatagaacctgcctgccctttctcccaaaaggacaaagaggtggccgagagagttttggaatttgacattggctggctggctgagcccattttcggctctggagattatccatgggtgatgagggactggctgaaccaaagaaacaattttcttcttccttatttcactgaagatgaaaaaaagctaatccagggtacctttgactttttggctttaagccattataccaccatccttgtagactcagaaaaagaagatccaataaaatacaatgattacctagaagtgcaagaaatgaccgacatcacgtggctcaactcccccagtcaggtggcggtagtgccctgggggttgcgcaaagtgctgaactggctgaagttcaagtacggagacctccccatgtacataatatccaacggaatcgatgacgggctgcatgctgaggacgaccagctgagggtgtattatatgcagaattacataaacgaagctctcaaagcccacatactggatggtatcaatctttgcggatactttgcttattcgtttaacgaccgcacagctccgaggtttggcctctatcgttatgctgcagatcagtttgagcccaaggcatccatgaaacattacaggaaaattattgacagcaatggtttcccgggcccagaaactctggaaagattttgtccagaagaattcaccgtgtgtactgagtgcagtttttttcacacccgaaagtctttactggctttcatagcttttctattttttgcttctattatttctctctcccttatattttactactcgaagaaaggcagaagaagttacaaatagttctgaacatttttctattcattcattttgaaataattatgcagacacatcagctgttaaccatttgcacctctaagtgttgtgaaactgtaaatttcatacatttgacttctagaaaacatttttgtggcttatgacagaggttttgaaatgggcataggtgatcgtaaaatattgaataatgcgaatagtgcctgaatttgttctctttttgggtgattaaaaaactgacaggcactataatttctgtaacacactaacaaaagcatgaaaaataggaaccacaccaatgcaacatttgtgcagaaatttgaatgacaagattaggaatattttcttctgcacccacttctaaatttaatgtttttctggaagtagtaattgcaagagttcgaatagaaagttatgtaccaagtaaccatttctcagctgccataataatgcctagtggcttcccctctgtcaaatctagtttcctatggaaaagaagatggcagatacaggagagacgacagagggtcctaggctggaatgttcctttcgaaagcaatgcttctatcaaatactagtattaatttatgtatctggttaatgacatacttggagagcaaattatggaaatgtgtattttatatgatttttgaggtcctgtctaaaccctgtgtccctgagggatctgtctcactggcatcttgttgagggccttgcacataggaaacttttgataagtatctgcggaaaaacaaacatgaatcctgtgatattgggctcttcaggaagcataaagcaattgtgaaatacagtataccgcagtggctctaggtggaggaaaggaggaaaaagtgcttattatgtgcaacattatgattaatctgattatacaccatttttgagcagatcttggaatgaatgacatgacctttccctagagaataaggatgaaataatcactcattctatgaacagtgacactactttctattctttagctgtactgtaatttctttgagttgatagttttacaaattcttaataggttcaaaagcaatctggtctgaataacactggatttgtttctgtgatctctgaggtctattttatgtttttgctgctacttctgtggaagtagctttgaactagttttactttgaactttcacgctgaaacatgctagtgatatctagaaagggctaattaggtctcatcctttaatgccccttaaataagtcttgctgattttcagacagggaagtctctctattacactggagctgttttatagataagtcaatattgtatcaggcaagataaaccaatgtcataacaggcattgccaacctcactgacacagggtcatagtgtataataatatactgtactatataatatatcatctttagaggtatgattttttcatgaaagataagcttttggtaatattcattttaaagtggacttattaaaattggatgctagagaatcaagtttattttatgtatatatttttctgattataagagtaatatatgttcattgtaaaaatttttaaaacacagaaactatatgcaaagaaaaaataaaaattatctataatctcagaacccagaaatagccactattaacatttcctacgtattttattttacatagatcatattgtatatagttagtatctttattaatttttattatgaaactttcctttgtcattattagtcttcaaaagcatgatttttaatagttgttgagtattccaccacaggaatgtatcacaacttaaccgttcccgtttgttagactagtttcttattaatgttgatgaatgttgtttaaaaataattttgttgctacatttactttaatttccttgactgtaaagagaagtaattttgctccttgataaagtattatattaataataaatctgcctgcaactttttgccttctttcataatc

SEQ ID NO: 313 - protein, 549 aa, Homo sapiens
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVSQLTKPISSLTKPYH

SEQ ID NO: 314 - DNA, 1717 bp, Homo sapiens
  CDS (260)..(973): NEUROG1 coding sequence
cacacgagctgatctgatcgccggcgacatcactcaggagaccggccgggcgcgtggcccctgcaggcgaggcgaggaggccaggccaagttctccgtgcgcccctgcacccttccaggctctcgcacccgcaactggcacagagtaacaaccccaggctgttgggaacgtaagtgcgccctggcggctctgccctcagtccgggctgcagcgctctgagcgcctttctatctgtccgtcggtcctgcacagcgcaacgatgccagcccgccttgagacctgcatctccgacctcgactgcgccagcagcagcggcagtgacctatccggcttcctcaccgacgaggaagactgtgccagactccaacaggcagcctccgcttcggggccgcccgcgccggcccgcaggggcgcgcccaatatctcccgggcgtctgaggttccaggggcacaggacgacgagcaggagaggcggcggcgccgcggccggacgcgggtccgctccgaggcgctgctgcactcgctgcgcaggagccggcgcgtcaaggccaacgatcgcgagcgcaaccgcatgcacaacttgaacgcggccctggacgcactgcgcagcgtgctgccctcgttccccgacgacaccaagctcaccaaaatcgagacgctgcgcttcgcctacaactacatctgggctctggccgagacactgcgcctggcggatcaagggctgcccggaggcggtgcccgggagcgcctcctgccgccgcagtgcgtcccctgcctgcccggtcccccaagccccgccagcgacgcggagtcctggggctcaggtgccgccgccgcctccccgctctctgaccccagtagcccagccgcctccgaagacttcacctaccgccccggcgaccctgttttctccttcccaagcctgcccaaagacttgctccacacaacgccctgtttcattccttaccactaggccctttgtagacactgttactttccccctcccctagtcagcaggcaatagatggggccccagctgccgcctcgggaccccctctccaggcggagggaggaagcgggagctttaaagcagtcggggatacctgagccgcttgttaggtcgccgcaccctcgcggcggatgtctcttggtctgtttctccggccctcagcccagcgcccctcctgcccgcccctagacggcctttccttttgcactttctgaactccacaaaacctcctttgtgactggctcagaactgaccccagccaccacttcagtgtgatttagaaaagggacagatcagcccctgaagacgaggtgaaaagtcaattttacaatttgtagaactctaatgaagaaaaacgagcatgaaaattcggtttgagccggctgacaatacaatgaaaaggcttaaaaagcagagacaaggagtgggcttcatgcattatggatcccgacccccaccactgcagactcgctctaggaagaactggagactcttgcttagctattcaggcacagggctggagagtactttaatttattcaagatgcttcattcatatgaaaatgtatttttgtacataaagagtttattctattatgagctatcaaagtttacatttttgtactgcagacgcttcatgtaaataaaaactaaaaataaaaaaaaaaaaaaaaaaaaaaaaaaaaaaaaaaaaaaaaaaaaaaaaaaa

SEQ ID NO: 315 - protein, 237 aa, Homo sapiens
MPARLETCISDLDCASSSGSDLSGFLTDEEDCARLQQAASASGPPAPARRGAPNISRASEVPGAQDDEQERRRRRGRTRVRSEALLHSLRRSRRVKANDRERNRMHNLNAALDALRSVLPSFPDDTKLTKIETLRFAYNYIWALAETLRLADQGLPGGGARERLLPPQCVPCLPGPPSPASDAESWGSGAAAASPLSDPSSPAASEDFTYRPGDPVFSFPSLPKDLLHTTPCFIPYH

SEQ ID NO: 316 - DNA, 7286 bp, Homo sapiens
  CDS (995)..(3328)
aggttatgtaagggtttgctttcaccccattcaaaaggtacctcttcctcttctcttgctccctctcgccctcattcttgtgcctatgcagacatttgagtagaggcgaatcactttcacttctgctggggaaattgcaacacgcttctttaaatggcagagagaaggagaaaacttagatcttctgataccaaatcactggaccttagaaggtcagaaatctttcaagccctgcaggaccgtaaaatgcgcatgtgtccaacggaagcactggggcatgagtggggaaggaatagaaacagaaagagggtaagagaagaaaaaagggaaagtggtgaaggcagggaggaaaattgcttagtgtgaatatgcacgcattcatttagttttcaaatccttgttgagcatgataaaattcccagcatcagacctcacatgttggtttccattaggatctgcctgggggaatatctgctgaatcagtggctctgagctgaactaggaaattcaccataattaggagagtcactgtatttctctccaaaaaaaaaaaagttatacccgagagacaggatcttctgatctgaaattttcttcacttctgaaattctctggtttgtgctcatcgttggtagctatttgttcatcaagagttgtgtagctggcttcttctgaaaaaaggaatctgcgtcatatctaagtcagatttcattctggtgctctcagagcagttagcccaggaaaggggccagcttctgtgacgactgctgcagaggcaggtgcagtttgtgtgccacagatattaactttgataagcacttaatgagtgccttctctgtgcgagaatggggaggaacaaaatgcagctcctaccctcctcgggctttagttgtaccttaataacaggaattttcatctgcctggctcctttcctcaaagaacaaagaagactttgcttcattaaagtgtctgagaaggaagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 317 - protein, 777 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 318 - DNA, 6614 bp, Homo sapiens
  CDS (323)..(2656)
aggttatgtaagggtttgctttcaccccattcaaaaggtacctcttcctcttctcttgctccctctcgccctcattcttgtgcctatgcagacatttgagtagaggcgaatcactttcacttctgctggggaaattgcaacacgcttctttaaatggcagagagaaggagaaaacttagatcttctgataccaaatcactggaccttagaaggtcagaaatctttcaagccctgcaggaccgtaaaatgcgcatgtgtccaacggaagcactggggcatgagtggggaaggaatagaaacagaaagaggttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 319 - protein, 777 aa, Homo sapiens; identical to SEQ ID NO: 317

SEQ ID NO: 320 - DNA, 6517 bp, Homo sapiens
  CDS (226)..(2559)
aggttatgtaagggtttgctttcaccccattcaaaaggtacctcttcctcttctcttgctccctctcgccctcattcttgtgcctatgcagacatttgagtagaggcgaatcactttcacttctgctggggaaattgcaacacgcttctttaaatggcagagagaaggagaaaacttagatcttctgataccaaatcactggaccttagaagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 321 - protein, 777 aa, Homo sapiens; identical to SEQ ID NO: 317

SEQ ID NO: 322 - DNA, 6410 bp, Homo sapiens
  CDS (119)..(2452)
cttctctcccagtgcgagagcgcggcggcggcagctgaagacccggccgcccagatgatgcggtggtgggggacctgccggcacgcgactccccccgggcccaaattgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 323 - protein, 777 aa, Homo sapiens; identical to SEQ ID NO: 317

SEQ ID NO: 324 - DNA, 6784 bp, Homo sapiens
  CDS (493)..(2826)
ggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaacctcgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 325 - protein, 777 aa, Homo sapiens; identical to SEQ ID NO: 317

SEQ ID NO: 326 - DNA, 4154 bp, Homo sapiens
  CDS (493)..(2721)
ggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaacctcgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaaaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 327 - protein, 742 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHENVMWLKPESTSHTLI

SEQ ID NO: 328 - DNA, 6787 bp, Homo sapiens
  CDS (493)..(2829)
ggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaacctcgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggtagacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 329 - protein, 778 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGRQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 330 - DNA, 2641 bp, Homo sapiens
  CDS (247)..(1536): RUNX3 coding sequence
ggcggcccactctgctctgtcagcttcggagctcctccaccctggctgccgaaagccccttcccgccatctaatgatacactctgcatacgcttctgttgagaatttgtggctagacattcctgtgggaccgggaatccaaattcttggtagctagaggaaaaaaaaataaaacaacagccaaccaagtgaatcccaacccaaccccctgaagggctgaaaattctcgccttcttcagagcggggcatggcatcgaacagcatcttcgactccttcccgacctactcgccgaccttcatccgcgacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaacaaaaaaaacaaaaaaaaaaaaaaaaaa

SEQ ID NO: 331 - protein, 429 aa, Homo sapiens
MASNSIFDSFPTYSPTFIRDPSTSRRFTPPSPAFPCGGGGGKMGENSGALSAQAAVGPGGRARPEVRSMVDVLADHAGELVRTDSPNFLCSVLPSHWRCNKTLPVAFKVVALGDVPDGTVVTVMAGNDENYSAELRNASAVMKNQVARFNDLRFVGRSGRGKSFTLTITVFTNPTQVATYHRAIKVTVDGPREPRRHRQKLEDQTKPFPDRFGDLERLRMRVTPSTPSPRGSLSTTSHFSSQPQTPIQGTSELNPFSDPRQFDRSFPTLPTLTESRFPDPRMHYPGAMSAAFPYSATPSGTSISSLSVAGMPATSRFHHTYLPPPYPGAPQNQSGPFQANPSPYHLYYGTSSGSYQFSMVAGSSSGGDRSPTRMLASCTSSAASVAAGNLMNPSLGGQSDGVEADGSHSNSPTALSTPGRMDEAVWRPY

SEQ ID NO: 332 - DNA, 3809 bp, Homo sapiens
  CDS (10)..(1257)
gccgctgttatgcgtattcccgtagacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacggtcccaggcccagagaagatgagtctatggcatcaggttcttaaaccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggcggaggtgggcaggatgtgagaggtggggagtactggctgtgcgtggcaggacagaagcactgtaaagggctctccagcgcagctcagctgcactgcgttccgaggtgaagtcttgcccctgaattttgcaaaatgggaaagtgggcgcttgccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgta

SEQ ID NO: 333 - protein, 415 aa, Homo sapiens
MRIPVDPSTSRRFTPPSPAFPCGGGGGKMGENSGALSAQAAVGPGGRARPEVRSMVDVLADHAGELVRTDSPNFLCSVLPSHWRCNKTLPVAFKVVALGDVPDGTVVTVMAGNDENYSAELRNASAVMKNQVARFNDLRFVGRSGRGKSFTLTITVFTNPTQVATYHRAIKVTVDGPREPRRHRQKLEDQTKPFPDRFGDLERLRMRVTPSTPSPRGSLSTTSHFSSQPQTPIQGTSELNPFSDPRQFDRSFPTLPTLTESRFPDPRMHYPGAMSAAFPYSATPSGTSISSLSVAGMPATSRFHHTYLPPPYPGAPQNQSGPFQANPSPYHLYYGTSSGSYQFSMVAGSSSGGDRSPTRMLASCTSSAASVAAGNLMNPSLGGQSDGVEADGSHSNSPTALSTPGRMDEAVWRPY

SEQ ID NO: 334 - DNA, 1216 bp, Homo sapiens
  CDS (155)..(790): SOCS1 coding sequence
ggcagctgcacggctcctggccccggagcatgcgcgagagccgccccggagcgccccggagccccccgccgtcccgcccgcggcgtcccgcgccccgccgccagcgcacccccggacgctatggcccacccctccggctggccccttctgtaggatggtagcacacaaccaggtggcagccgacaatgcagtctccacagcagcagagccccgacggcggccagaaccttcctcctcttcctcctcctcgcccgcggcccccgcgcgcccgcggccgtgccccgcggtcccggccccggcccccggcgacacgcacttccgcacattccgttcgcacgccgattaccggcgcatcacgcgcgccagcgcgctcctggacgcctgcggattctactgggggcccctgagcgtgcacggggcgcacgagcggctgcgcgccgagcccgtgggcaccttcctggtgcgcgacagccgccagcggaactgctttttcgcccttagcgtgaagatggcctcgggacccacgagcatccgcgtgcactttcaggccggccgctttcacctggatggcagccgcgagagcttcgactgcctcttcgagctgctggagcactacgtggcggcgccgcgccgcatgctgggggccccgctgcgccagcgccgcgtgcggccgctgcaggagctgtgccgccagcgcatcgtggccaccgtgggccgcgagaacctggctcgcatccccctcaaccccgtcctccgcgactacctgagctccttccccttccagatttgaccggcagcgcccgccgtgcacgcagcattaactgggatgccgtgttattttgttattacttgcctggaaccatgtgggtaccctccccggcctgggttggagggagcggatgggtgtaggggcgaggcgcctcccgccctcggctggagacgaggccgcagaccccttctcacctcttgagggggtcctccccctcctggtgctccctctgggtccccctggttgttgtagcagcttaactgtatctggagccaggacctgaactcgcacctcctacctcttcatgtttacatatacccagtatctttgcacaaaccaggggttgggggagggtctctggctttatttttctgctgtgcagaatcctattttatattttttaaagtcagtttaggtaataaactttattatgaaagtttttttttt

SEQ ID NO: 335 - protein, 211 aa, Homo sapiens
MVAHNQVAADNAVSTAAEPRRRPEPSSSSSSSPAAPARPRPCPAVPAPAPGDTHFRTFRSHADYRRITRASALLDACGFYWGPLSVHGAHERLRAEPVGTFLVRDSRQRNCFFALSVKMASGPTSIRVHFQAGRFHLDGSRESFDCLFELLEHYVAAPRRMLGAPLRQRRVRPLQELCRQRIVATVGRENLARIPLNPVLRDYLSSFPFQI
